United States Patent
Lutz et al.

(10) Patent No.: US 12,097,253 B2
(45) Date of Patent: *Sep. 24, 2024

(54) RSV RNA MOLECULES AND COMPOSITIONS FOR VACCINATION

(71) Applicant: CureVac SE, Tübingen (DE)

(72) Inventors: Johannes Lutz, Tübingen (DE); Susanne Rauch, Tübingen (DE); Regina Heidenreich, Tübingen (DE); Benjamin Petsch, Tübingen (DE)

(73) Assignee: CureVac SE, Tübingen (DE)

( * ) Notice: Subject to any disclaimer, the term of this patent is extended or adjusted under 35 U.S.C. 154(b) by 0 days.

This patent is subject to a terminal disclaimer.

(21) Appl. No.: 18/590,312

(22) Filed: Feb. 28, 2024

(65) Prior Publication Data

US 2024/0245764 A1 Jul. 25, 2024

Related U.S. Application Data

(63) Continuation of application No. 17/047,947, filed as application No. PCT/EP2019/060000 on Apr. 17, 2019.

(30) Foreign Application Priority Data

Apr. 17, 2018 (WO) ............... PCT/EP2018/059799
Apr. 26, 2018 (WO) ............... PCT/EP2018/060810
May 3, 2018 (WO) ............... PCT/EP2018/061423

(51) Int. Cl.
| | |
|---|---|
| *A61K 39/155* | (2006.01) |
| *A61P 31/14* | (2006.01) |
| *A61P 37/04* | (2006.01) |
| *C07K 14/005* | (2006.01) |
| *C12N 7/00* | (2006.01) |
| *C12N 15/88* | (2006.01) |
| *A61K 39/00* | (2006.01) |

(52) U.S. Cl.
CPC ............ *A61K 39/155* (2013.01); *A61P 31/14* (2018.01); *A61P 37/04* (2018.01); *C07K 14/005* (2013.01); *C12N 7/00* (2013.01); *C12N 15/88* (2013.01); *A61K 2039/53* (2013.01); *A61K 2039/6018* (2013.01); *C12N 2760/18522* (2013.01); *C12N 2760/18534* (2013.01)

(58) Field of Classification Search
None
See application file for complete search history.

(56) References Cited

U.S. PATENT DOCUMENTS

| | | |
|---|---|---|
| 7,709,007 B2 | 5/2010 | Murphy et al. |
| 9,688,729 B2 | 6/2017 | Kramps et al. |
| 10,017,543 B2 | 7/2018 | Kwong et al. |
| 10,150,797 B2 | 12/2018 | Kramps et al. |
| 11,034,729 B2 | 6/2021 | Kramps et al. |
| 11,739,125 B2 | 8/2023 | Kramps et al. |
| 11,911,453 B2 * | 2/2024 | Ciaramella ........ A61K 31/7115 |
| 11,965,000 B2 | 4/2024 | Kramps et al. |
| 2005/0032730 A1 | 2/2005 | von der Mülbe et al. |
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2015/0037326 A1 | 2/2015 | Butler-Ransohoff et al. |
| 2015/0050302 A1 | 2/2015 | Thess |

(Continued)

FOREIGN PATENT DOCUMENTS

| | | |
|---|---|---|
| JP | 2015-501844 | 1/2015 |
| RU | 2 625 546 C2 | 7/2017 |

(Continued)

OTHER PUBLICATIONS

"SCORE 17047947 seq 483 v 370 year 2022," Jun. 17, 2022.
Dressman et al., "Gene expression profiling detects gene amplification and differentiates tumor types in breast cancer," *Cancer Research*, 63(9):2194-2199, 2003.

(Continued)

*Primary Examiner* — Shanon A. Foley
*Assistant Examiner* — Myron G Hill
(74) *Attorney, Agent, or Firm* — Parker Highlander PLLC

(57) ABSTRACT

The present invention is directed to an artificial nucleic acid, particularly to an artificial RNA suitable for use in treatment and/or prophylaxis of an infection with Respiratory syncytial virus (RSV) or a disorder related to such an infection. The invention further concerns a method of treating or preventing a disorder or a disease, first and second medical uses of the artificial RNA, compositions, and vaccines. Further, the invention is directed to a kit, particularly to a kit of parts, comprising the artificial RNA, compositions and vaccines.

45 Claims, 32 Drawing Sheets
Specification includes a Sequence Listing.

(56) References Cited

U.S. PATENT DOCUMENTS

| | | |
|---|---|---|
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | von der Mülbe |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |
| 2019/0194760 A1 | 6/2019 | Koch et al. |
| 2019/0225971 A1 | 7/2019 | Williams |
| 2019/0241633 A1 | 8/2019 | Fotin-Mleczek et al. |
| 2019/0249219 A1 | 8/2019 | Reichert et al. |
| 2019/0336608 A1 | 11/2019 | Baumhof et al. |
| 2019/0336611 A1 | 11/2019 | Baumhof et al. |
| 2019/0343933 A1 | 11/2019 | Horscroft et al. |
| 2019/0343942 A1 | 11/2019 | Fotin-Mleczek et al. |
| 2019/0351044 A1 | 11/2019 | Jasny et al. |
| 2019/0351047 A1 | 11/2019 | Jasny et al. |
| 2019/0351048 A1 | 11/2019 | Rauch |
| 2019/0381180 A1 | 12/2019 | Baumhof et al. |
| 2020/0023076 A1 | 1/2020 | Fotin-Mleczek et al. |
| 2020/0085852 A1 | 3/2020 | Fotin-Mleczek |
| 2020/0085944 A1 | 3/2020 | Heidenreich et al. |
| 2020/0149026 A1 | 5/2020 | Horscroft et al. |
| 2020/0163878 A1 | 5/2020 | Baumhof et al. |
| 2020/0179526 A1 | 6/2020 | Baumhof et al. |
| 2020/0318097 A1 | 10/2020 | Funkner et al. |
| 2020/0392572 A1 | 12/2020 | Yazdan Panah et al. |
| 2021/0030864 A1 | 2/2021 | Petsch et al. |
| 2021/0069315 A1 | 3/2021 | Baumhof et al. |
| 2021/0162037 A1 | 6/2021 | Jasny et al. |
| 2021/0170017 A1 | 6/2021 | Lutz et al. |
| 2021/0180106 A1 | 6/2021 | Wochner et al. |
| 2021/0205434 A1 | 7/2021 | Petsch et al. |
| 2021/0260178 A1 | 8/2021 | Jasny et al. |
| 2021/0261897 A1 | 8/2021 | Yazdan Panah et al. |
| 2021/0361761 A1 | 11/2021 | Lutz et al. |
| 2021/0379181 A1 | 12/2021 | Rauch et al. |
| 2021/0403925 A1 | 12/2021 | Chevessier-Tünnesen et al. |
| 2022/0040281 A1 | 2/2022 | Schwendt et al. |
| 2022/0073962 A1 | 3/2022 | Schwenger et al. |

FOREIGN PATENT DOCUMENTS

| | | | |
|---|---|---|---|
| WO | WO-2010149745 A1 * | 12/2010 | ............ A61K 39/12 |
| WO | WO 2012/006380 | 1/2012 | |
| WO | WO 2012/037078 | 3/2012 | |
| WO | WO 2012/158613 | 11/2012 | |
| WO | WO 2013/090648 | 6/2013 | |
| WO | WO 2014/160463 | 10/2014 | |
| WO | WO 2015/024668 | 2/2015 | |
| WO | WO 2015/199952 | 12/2015 | |
| WO | WO 2017/062513 | 4/2017 | |
| WO | WO 2017/070622 | 4/2017 | |
| WO | WO 2017/075531 | 5/2017 | |
| WO | WO 2017/172890 | 10/2017 | |
| WO | WO 2018/078053 | 5/2018 | |
| WO | WO 2018/170260 | 9/2018 | |
| WO | WO 2018/211038 | 11/2018 | |
| WO | WO 2019/077001 | 4/2019 | |
| WO | WO 2019/092153 | 5/2019 | |
| WO | WO 2020/123300 | 6/2020 | |
| WO | WO 2020/161342 | 8/2020 | |
| WO | WO 2020/254535 | 12/2020 | |
| WO | WO 2021/028439 | 2/2021 | |
| WO | WO 2021/239880 | 12/2021 | |

OTHER PUBLICATIONS

Joyce et al., "Iterative structure-based improvement of a fusion-glycoprotein vaccine against RSV," *Nature Structural & Molecular Biology*, 23:811-820, 2016.

McLellan et al., "Structure of RSV fusion glycoprotein trimer bound to a prefusion-specific neutralizing antibody," *Science*, 340:1113-1117, 2013.

McLellan et al., "Structure-based design of a fusion glycoprotein vaccine for respiratory syncytial virus," *Science*, 342(6158):592-598, 2013.

Office Action issued in U.S. Appl. No. 17/047,947, mailed Dec. 6, 2023.

Office Action issued in U.S. Appl. No. 17/047,947, mailed Feb. 1, 2023.

Office Action issued in U.S. Appl. No. 17/047,947, mailed Jun. 23, 2022.

Office Action issued in U.S. Appl. No. 17/047,947, mailed Jan. 5, 2022.

Pakula & Sauer, "Genetic analysis of protein stability and function," *Annu. Rev. Genet.*, 23:289-310, 1989.

PCT International Search Report and Written Opinion issued in International Application No. PCT/EP2019/060000, mailed Mar. 9, 2019.

Pierantoni et al., "Mucosal delivery of a vectored RSV vaccine is safe and elicits. Protective immunity in rodents and nonhuman primates," *Molecular Therapy—Methods & Clinical Development*, 2:15018, 2015.

Anderson et al., "Strategic priorities for respiratory syncytial virus (RSV) vaccine development," *Vaccine*, 31S:B209-B215, 2013.

Geall et al., "Nonviral delivery of self-amplifying RNA vaccines," *Proc Natl Acad Sci USA*, 109:14604-14609, 2012.

GenBank Accession No. EF566942, 2007, p. 1-2.

Hashimoto et al., "Neutralizing epitopes of RSV and palivizumab resistance in Japan", *Fukushima J. Med. Sci.*, 63(3):127-134, 2017.

Hause et al., "Sequence variability of the respiratory syncytial virus (RSV) fusion gene among contemporary and historical genotypes of RSV/A and RSV/B", *PLoS ONE*, 12(4):e0175792, 2017.

(56) References Cited

OTHER PUBLICATIONS

Higgins et al., "Advances in RSV vaccine research and development—A global agenda," *Vaccine*, 34(26):2870-2875, 2016.

McLellan et al., "Structure and Function of Respiratory Syncytial Virus Surface Glycoproteins", *Curr. Top. Microbiol. Immunol.*, 372:83-104, 2014.

Oomens et al., "The cytoplasmic tail of the human respiratory syncytial virus F protein plays critical roles in cellular localization of the F protein and infectious progeny production," *Journal of Virology*, 80(21):10465-10477, 2006.

Ternette et al. "Expression of RNA virus proteins by RNA polymerase II dependent expression plasmids is hindered at multiple steps," Virology Journal, 4:51, 2007, p. 1-10.

* cited by examiner

FIG. 18

RSV RNA MOLECULES AND COMPOSITIONS FOR VACCINATION

The present application is a continuation of U.S. application Ser. No. 17/047,947, filed Oct. 15, 2020, which is a national phase application under 35 U.S.C. § 371 of International Application No. PCT/EP2019/060000, filed Apr. 17, 2019, which claims the priority benefit of International Application No. PCT/EP2018/061423, filed May 3, 2018, International Application No. PCT/EP2018/060810, filed Apr. 26, 2018, and International Application No. PCT/EP2018/059799, filed Apr. 17, 2018, the entire contents of each of which are hereby incorporated by reference.

This application contains a Sequence Listing XML, which has been submitted electronically and is hereby incorporated by reference in its entirety. Said Sequence Listing XML, created on Feb. 28, 2024, is named CRVCP0281USC1.xml and is 66,277,119 bytes in size.

INTRODUCTION

The present invention is directed to artificial RNA suitable for use in the treatment or prophylaxis of an infection with Respiratory syncytial virus (RSV) or of a disorder related to such an infection. In particular, the artificial RNA of the invention comprises at least one heterologous untranslated region (UTR), preferably a 3'-UTR and/or a 5'-UTR, and a coding region encoding at least one antigenic peptide or protein derived from RSV, in particular at least one antigenic peptide or protein derived from RSV fusion (F) protein. The artificial RNA is preferably characterized by increased expression efficacies of coding regions operably linked to said UTR elements. The present invention is also directed to compositions and vaccines comprising said artificial RNA in association with a polymeric carrier, a polycationic protein or peptide, or a lipid nanoparticle (LNP). Further, the invention concerns a kit, particularly a kit of parts comprising the artificial RNA or composition or vaccine. The invention is further directed to a method of treating or preventing a disorder or a disease, and first and second medical uses of the artificial RNA, composition, or vaccine.

Respiratory syncytial virus (RSV) is an enveloped non-segmented negative-strand RNA virus in the family Paramyxoviridae, genus Pneumovirus. It is the most common cause of bronchiolitis and pneumonia among children in their first year of life. RSV also causes repeated infections including severe lower respiratory tract disease, which may occur at any age, especially among the elderly or those with compromised cardiac, pulmonary, or immune systems. Currently, passive immunization is used to prevent severe illness caused by RSV infection, especially in infants with prematurity, bronchopulmonary dysplasia, or congenital heart disease.

Recommended treatment of RSV bronchiolitis primarily consists of respiratory support and hydration. No specific anti-viral therapy is recommended. The neutralizing monoclonal antibody Palivizumab is used for prophylaxis of infants at highest risk for severe infection but is too expensive and impractical for universal use. Currently, there is no licensed/approved RSV vaccine, and developing a safe and effective RSV vaccine is a global public health priority.

In a vaccine trial in the 1960s, infants and young children were immunized with a formalin-inactivated whole virion RSV preparation (FIRSV) or an equivalent paramyxovirus preparation (FIPIV). Five percent of the subjects who were immunized with FI-PIV and then naturally infected by RSV during the next RSV season were hospitalized; 80% of those who were immunized with FI-RSV and then infected by RSV were hospitalized, and two children died. This enhancement of an RSV infection due to vaccination is a specific problem for the development of vaccines against RSV infections.

Therefore, Respiratory syncytial virus (RSV) infections are the greatest remaining unmet infant vaccine need in developed countries and an important unmet infant vaccine need worldwide. More than 40 years of effort have not yet resulted in a licensed RSV vaccine for humans.

Despite the above mentioned humanized monoclonal antibody Palivizumab, live-attenuated vaccine viruses were developed which elicit a strong immune response, but which are not recommended for use in the specific target groups (infants, children, the elderly and immunocompromised patients). Also, DNA vectors expressing RSV F protein which bears B-cell epitopes were used to induce the production of neutralizing antibodies. In this context, WO2008/077527 and WO96/040945 disclose vectors comprising DNA sequences encoding RSV F protein for the use as vaccines. However, the use of DNA as a vaccine may be dangerous due to unwanted insertion into the genome, possibly leading to interruption of functional genes and cancer or the formation of anti-DNA antibodies.

WO2015/024668 discloses RNA sequences encoding RSV antigenic peptides and proteins selected from fusion protein F, the glycoprotein G, the short hydrophobic protein SH, the matrix protein M, the nucleoprotein N, the large polymerase L, the M2-1 protein, the M2-2 protein, the phosphoprotein P, the non-structural protein NS1 or the non-structural protein NS2, and an antigenic composition comprising protamine-complexed RNA suitable for intradermal administration.

WO2017/070622 discloses a vaccine comprising RNA encoding RSV antigenic peptides and proteins selected from glycoprotein F and glycoprotein G, wherein the RNA is formulated in lipid nanoparticles.

Apart from some approaches cited above, there remains an unmet medical need for an efficient vaccine for prophylaxis or treatment of RSV infections.

Accordingly, it is the object of the underlying invention to provide novel artificial RNA coding for antigenic peptides or proteins of RSV and compositions/vaccines comprising said RNA for the use as vaccine for prophylaxis or treatment of RSV infections, particularly in infants, newborns, pregnant women, elderly, and immunocompromised patients.

Further it would be desirable that an RNA-based composition or vaccine has some of the following advantageous features:

Improved translation of RNA constructs at the site of injection (e.g. muscle)
Very efficient induction of RSV antigen-specific immune responses against the encoded antigenic peptide or protein at a very low dosages and dosing regimen.
Suitability for maternal immunization
Suitability for vaccination of infants and/or newborns
Suitability for intramuscular administration
Induction of an RSV-specific functional humoral immune response
Induction of RSV-specific B-cell memory
Faster onset of immune protection against RSV
Longevity of the induced immune responses against RSV
Induction of broad cellular T-cell responses against RSV
Induction of a (local and transient) pro-inflammatory environment
No induction of systemic cytokine or chemokine response after application of the vaccine Well tolerability, no side-effects, non toxic, No enhancement of an RSV infection due to vaccination Advantageous stability characteristics of the vaccine Speed, adaptability, simplicity and scalability of RSV vaccine production The objects outlined above are solved by the claimed subject matter.

Definitions

For the sake of clarity and readability the following definitions are provided. Any technical feature mentioned for these definitions may be read on each and every embodiment of the invention. Additional definitions and explanations may be specifically provided in the context of these embodiments.

Percentages in the context of numbers should be understood as relative to the total number of the respective items. In other cases, and unless the context dictates otherwise, percentages should be understood as percentages by weight (wt.-%).

Adaptive immune response: The term "adaptive immune response" as used herein will be recognized and understood by the person of ordinary skill in the art, and is for example intended to refer to an antigen-specific response of the immune system (the adaptive immune system). Antigen specificity allows for the generation of responses that are tailored to specific pathogens or pathogen-infected cells. The ability to mount these tailored responses is usually maintained in the body by "memory cells" (B-cells). In the context of the invention, the antigen is provided by the artificial RNA coding sequence encoding at least one antigenic peptide or protein.

Antigen: The term "antigen" as used herein will be recognized and understood by the person of ordinary skill in the art, and is for example intended to refer to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein which may be presented by the MHC to T-cells. Also fragments, variants and derivatives of peptides or proteins derived from e.g. RSV F protein comprising at least one epitope are understood as antigens in the context of the invention. In the context of the present invention, an antigen may be the product of translation of a provided artificial RNA as specified herein.

Anticenic peptide or protein: The term "antigenic peptide or protein" will be recognized and understood by the person of ordinary skill in the art, and is for example intended to refer to a peptide, protein (or polyprotein) derived from a (antigenic) protein/polyprotein which may stimulate the body's adaptive immune system to provide an adaptive immune response. Therefore an "antigenic peptide or protein" comprises at least one epitope (as defined herein) or antigen (as defined herein) of the protein it is derived from (e.g., in the context of the invention, RSV peptide or protein, preferably RSV F protein or variants thereof).

Artificial nucleic acid: The terms "artificial nucleic acid" as used herein will be recognized and understood by the person of ordinary skill in the art, and are for example intended to refer to an artificial nucleic acid that does not occur naturally. An artificial nucleic acid may be a DNA molecule, an RNA molecule or a hybrid-molecule comprising DNA and RNA portions. Typically, artificial nucleic acids may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" as used herein will be recognized and understood by the person of ordinary skill in the art, and is for example intended to refer to a sequence occurring in nature. Further, the term "artificial nucleic acid" is not restricted to mean "one single molecule" but is, typically, understood to comprise an ensemble of essentially identical molecules.

Artificial RNA: The term "artificial RNA" as used herein is intended to refer to an RNA that does not occur naturally. In other words, an artificial RNA may be understood as a non-natural nucleic acid molecule. Such RNA molecules may be non-natural due to its individual sequence (which does not occur naturally, e.g. G/C content modified coding sequence, UTRs) and/or due to other modifications, e.g. structural modifications of nucleotides which do not occur naturally. Typically, artificial RNA may be designed and/or generated by genetic engineering methods to correspond to a desired artificial sequence of nucleotides (heterologous sequence). In this context an artificial RNA sequence is usually a sequence that may not occur naturally, i.e. it differs from the wild type sequence by at least one nucleotide. The term "artificial RNA" is not restricted to mean "one single molecule" but is, typically, understood to comprise an ensemble of essentially identical molecules. Accordingly, it may relate to a plurality of essentially identical RNA molecules contained in an aliquot or a sample. In the context of the invention, the RNA of the invention is an artificial RNA as defined herein.

Cationic: Unless a different meaning is clear from the specific context, the term "cationic" means that the respective structure bears a positive charge, either permanently or not permanently but in response to certain conditions such as pH. Thus, the term "cationic" covers both "permanently cationic" and "cationisable".

Cationisable: The term "cationisable" as used herein means that a compound, or group or atom, is positively charged at a lower pH and uncharged at a higher pH of its environment. Also in non-aqueous environments where no pH value can be determined, a cationisable compound, group or atom is positively charged at a high hydrogen ion concentration and uncharged at a low concentration or activity of hydrogen ions. It depends on the individual properties of the cationisable or polycationisable compound, in particular the pKa of the respective cationisable group or atom, at which pH or hydrogen ion concentration it is charged or uncharged. In diluted aqueous environments, the fraction of cationisable compounds, groups or atoms bearing a positive charge may be estimated using the so-called Henderson-Hasselbalch equation which is well-known to a person skilled in the art. For example, in some embodiments, if a compound or moiety is cationisable, it is preferred that it is positively charged at a pH value of about 1 to 9, preferably 4 to 9, 5 to 8 or even 6 to 8, more preferably of a pH value of or below 9, of or below 8, of or below 7, most preferably at physiological pH values, e.g. about 7.3 to 7.4, i.e. under physiological conditions, particularly under physiological salt conditions of the cell in vivo. In other embodiments, it is preferred that the cationisable compound or moiety is predominantly neutral at physiological pH values, e.g. about 7.0-7.4, but becomes positively charged at lower pH values. In some embodiments, the preferred range of pKa for the cationisable compound or moiety is about 5 to about 7.

Coding sequence/coding region: The terms "coding sequence" or "coding region" and the corresponding abbreviation "cds" as used herein will be recognized and understood by the person of ordinary skill in the art, and are for example intended to refer to a sequence of several nucleotide triplets, which may be translated into a peptide or protein. A coding sequence in the context of the present invention is preferably an RNA sequence, consisting of a number of nucleotides that may be divided by three, which starts with a start codon and which preferably terminates with a stop codon.

Composition: In the context of the invention, a "composition" refers to any type of composition in which the specified ingredients (e.g. artificial RNA of the invention in association with LNP), may be incorporated, optionally along with any further constituents, usually with at least one pharmaceutically acceptable carrier or excipient. Thus, the composition may be a dry composition such as a powder or granules, or a solid unit such as a lyophilized form or a tablet. Alternatively, the composition may be in liquid form, and each constituent may be independently incorporated in dissolved or dispersed (e.g. suspended or emulsified) form.

Compound: As used herein, a "compound" means a chemical substance, which is a material consisting of molecules having essentially the same chemical structure and properties. For a small molecular compound, the molecules are typically identical with respect to their atomic composition and structural configuration. For a macromolecular or polymeric compound, the molecules of a compound are highly similar but not all of them are necessarily identical. For example, a segment of a polymer that is designated to consist of 50 monomeric units may also contain individual molecules with e.g. 48 or 53 monomeric units.

Derived from: The term "derived from" as used throughout the present specification in the context of a nucleic acid, i.e. for a nucleic acid "derived from" (another) nucleic acid, means that the nucleic acid, which is derived from (another) nucleic acid, shares at least 50%, preferably at least 55%, preferably at least 60%, preferably at least 65%, preferably at least 70%, more preferably at least 75%, more preferably at least 80%, 81%, 82%, 83%, 84%, more preferably at least 85%, 86%, 87%, 88%, 89% even more preferably at least 90%, 91%, 92%, 93%, 94%, even more preferably at least 95%, 96%, 97%, and particularly preferably at least 98%, 99% sequence identity with the nucleic acid from which it is derived. The skilled person is aware that sequence identity is typically calculated for the same types of nucleic acids, i.e. for DNA sequences or for RNA sequences. Thus, it is understood, if a DNA is "derived from" an RNA or if an RNA is "derived from" a DNA, in a first step the RNA sequence is converted into the corresponding DNA sequence (in particular by replacing the uracils (U) by thymidines (T) throughout the sequence) or, vice versa, the DNA sequence is converted into the corresponding RNA sequence (in particular by replacing the thymidines (T) by uracils (U) throughout the sequence). Thereafter, the sequence identity of the DNA sequences or the sequence identity of the RNA sequences is determined. Preferably, a nucleic acid "derived from" a nucleic acid also refers to nucleic acid, which is modified in comparison to the nucleic acid from which it is derived, e.g. in order to increase RNA stability even further and/or to prolong and/or increase protein production. It goes without saying that such modifications are preferred, which do not impair RNA stability, e.g. in comparison to the nucleic acid from which it is derived. In the context of amino acid sequences (e.g. antigenic peptides or proteins) the term "derived from" means that the amino acid sequence, which is derived from (another) amino acid sequence (e.g. RSV F protein), shares at least 50%, preferably at least 55%, preferably at least 60%, preferably at least 65%, preferably at least 70%, more preferably at least 75%, more preferably at least 80%, 81%, 82%, 83%, 84%, more preferably at least 85%, 86%, 87%, 88%, 89% even more preferably at least 90%, 91%, 92%, 93%, 94%, even more preferably at least 95%, 96%, 97%, and particularly preferably at least 98%, 99% sequence identity with the amino acid sequence from which it is derived.

Thus, it is understood, if a antigenic peptides or protein is "derived from" an RSV fusion (F) protein, the antigenic peptides or protein that is "derived from" said RSV F protein may represent a variant or fragment of the RSV F protein, e.g. F0 (full-length precursor), F-del, F0_DSCav1, F_DSCav1_mut1, F_DSCav1_mut2, F_DSCav1_mut3, F-del_DSCav1, F-del_DSCav1_mut1, F-del_DSCav1_mut2, F-del_DSCav1_mut3 (as specified herein). Moreover, the antigenic peptides or protein that is "derived from" said RSV F proteins (e.g., F0, F-del, F0_DSCav1, F_DSCav1_mut1, F_DSCav1_mut2, F_DSCav1_mut3, F-del_DSCav1, F-del_DSCav1_mut1, F-del_DSCav1_mut2, F-del_DSCav1_mut3) may differ in the amino acid sequence, sharing a certain percentage of identity as defined above. Suitable further examples of RSV F proteins from which an antigenic peptides or protein may be "derived from" are provided in Table 1.

Epitore: The term "epitope" (also called "antigen determinant" in the art) as used herein will be recognized and understood by the person of ordinary skill in the art, and is for example intended to refer to T cell epitopes and B cell epitopes. T cell epitopes or parts of the antigenic peptides or proteins may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 to about 20 or even more amino acids, wherein these fragments may be selected from any part of the amino acid sequence. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens, preferably having 5 to 15 amino acids, more preferably having 5 to 12 amino acids, even more preferably having 6 to 9 amino acids, which may be recognized by antibodies, i.e. in their native form. Such epitopes of proteins or peptides may furthermore be selected from any of the herein mentioned variants of such proteins or peptides. In this context antigenic determinants can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain. In the context of the present invention, an epitope may be the product of translation of a provided artificial RNA as specified herein.

Fragment: The term "fragment" as used throughout the present specification in the context of a nucleic acid sequence or an amino acid sequence may typically be a shorter portion of a full-length sequence of e.g. a nucleic acid sequence or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 5%, 10%, 20%, preferably at least 30%, more preferably at least 40%, more preferably at least 50%, even more preferably at least 60%, even more preferably at least 70%, and most preferably at least 80% of the total (i.e. full-length) molecule from which the fragment is derived (e.g. RSV F protein). The term "fragment" as used throughout the present specification in the context of proteins or peptides may, typically, comprise a sequence of a protein or peptide as defined herein, which is, with regard to its amino acid sequence (or its encoded nucleic acid molecule), N-terminally and/or C-terminally truncated compared to the amino acid sequence of the original (native) protein (or its encoded nucleic acid molecule). Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide. In the context of antigens such fragment may have a length of about 6 to about 20 or even more amino acids, e.g. fragments as processed and presented by MHC class I molecules, preferably having a length of about 8 to about 10 amino acids, e.g. 8, 9, or 10, (or even 6, 7, 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T-cells in form of a complex consisting of the peptide fragment and an MHC molecule, i.e. the fragments are typically not recognized in their native form. Fragments of proteins or peptides (e.g. in the context of antigens) may comprise at least one epitope of those proteins or peptides. Furthermore also domains of a protein, like the extracellular domain, the intracellular domain or the transmembrane domain and shortened or truncated versions of a protein may be understood to comprise a fragment of a protein.

Heterologous: The terms "heterologous" or "heterologous sequence" as used throughout the present specification in the context of a nucleic acid sequence or an amino acid sequence refers to a sequence (e.g. DNA, RNA, amino acid) will be recognized and understood by the person of ordinary skill in the art, and is intended to refer to a sequence that is derived from another gene, from another allele, from another species. Two sequences are typically understood to be "heterologous" if they are not derivable from the same gene or in the same allele. I.e., although heterologous sequences may be derivable from the same organism, they naturally (in nature) do not occur in the same nucleic acid molecule, such as e.g. in the same RNA, or the same protein.

Humoral immune response: The terms "humoral immunity" or "humoral immune response" will be recognized and understood by the person of ordinary skill in the art, and are for example intended to refer to B-cell mediated antibody production and optionally to accessory processes accompanying antibody production. A humoral immune response may be typically characterized, e.g. by Th2 activation and cytokine production, germinal center formation and isotype switching, affinity maturation and memory cell generation.

Humoral immunity also typically may refer to the effector functions of antibodies, which include pathogen and toxin neutralization, classical complement activation, and opsonin promotion of phagocytosis and pathogen elimination.

Identity (of a sequence): The term "identity" as used throughout the present specification in the context of a nucleic acid sequence or an amino acid sequence will be recognized and understood by the person of ordinary skill in the art, and is for example intended to refer to the percentage to which two sequences are identical. To determine the percentage to which two sequences are identical, e.g. nucleic acid sequences or amino acid sequences as defined herein, preferably the amino acid sequences encoded by the artificial nucleic acid sequence as defined herein or the amino acid sequences themselves, the sequences can be aligned in order to be subsequently compared to one another. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm is integrated in the BLAST program. Sequences which are identical to the sequences of the present invention to a certain extent can be identified by this program.

Immunogen, immunogenic: The terms "immunogen" or "immunogenic" will be recognized and understood by the person of ordinary skill in the art, and are for example intended to refer to a compound that is able to stimulate/induce an immune response. Preferably, an immunogen is a peptide, polypeptide, or protein. An immunogen in the sense of the present invention is the product of translation of a provided artificial nucleic acid, preferably RNA, comprising at least one coding sequence encoding at least one antigenic peptide, protein derived from RSV as defined herein. Typically, an immunogen elicits an adaptive immune response.

Immune response: The term "immune response" will be recognized and understood by the person of ordinary skill in the art, and is for example intended to refer to a specific reaction of the adaptive immune system to a particular antigen (so called specific or adaptive immune response) or an unspecific reaction of the innate immune system (so called unspecific or innate immune response), or a combination thereof.

Immune system: The term "immune system" will be recognized and understood by the person of ordinary skill in the art, and is for example intended to refer to a system of the organism that may protect the organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Innate immune system: The term "innate immune system" (also known as non-specific or unspecific immune system) will be recognized and understood by the person of ordinary skill in the art, and is for example intended to refer to a system typically comprising the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be, e.g. activated by ligands of Toll-like receptors (TLRs) or other auxiliary substances such as lipopolysaccharides, TNF-alpha, CD40 ligand, or cytokines, monokines, lymphokines, interleukins or chemokines, IL-1 to IL-33, IFN-alpha, IFN-beta, IFN-gamma, GM-CSF, G-CSF, M-CSF, LT-beta, TNF-alpha, growth factors, and hGH, a ligand of human Toll-like receptor (e.g., TLR1 to TLR10), a ligand of murine Toll-like receptor, (e.g., TLR1 to TLR13), a ligand of a NOD-like receptor, a ligand of a RIG-1 like receptor, an immunostimulatory nucleic acid, an immunostimulatory RNA (isRNA), a CpG-DNA, an anti-bacterial agent, or an anti-viral agent.

Lipidoid compound: A lipidoid compound, also simply referred to as lipidoid, is a lipid-like compound, i.e. an amphiphilic compound with lipid-like physical properties. In the context of the present invention the term lipid is considered to encompass lipidoid compounds.

Monovalent vaccine, monovalent composition: The terms "monovalent vaccine", "monovalent composition" "univalent vaccine" or "univalent composition" will be recognized and understood by the person of ordinary skill in the art, and are for example intended to refer to a composition or a vaccine comprising only one antigen from a virus. Accordingly, said vaccine or composition comprises only one RNA species encoding a single antigen for a single organism. The term "monovalent vaccine" includes the immunization against a single valence. In the context of the invention, a monovalent RSV vaccine or composition would comprise an artificial RNA encoding one single antigenic peptide or protein derived from one specific RSV (e.g. RSV F).

Nucleic acid: The terms "nucleic acid" or "nucleic acid molecule" will be recognized and understood by the person of ordinary skill in the art, and are for example intended to refer to a molecule comprising, preferably consisting of nucleic acid components. The term nucleic acid molecule preferably refers to DNA or RNA molecules. It is preferably used synonymous with the term polynucleotide. Preferably, a nucleic acid or a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified DNA or RNA molecules as defined herein.

Nucleic acid sequence/RNA sequence/amino acid sequence: The terms "nucleic acid sequence", "RNA sequence" or "amino acid sequence" will be recognized and understood by the person of ordinary skill in the art, and are for example intended to refer to particular and individual order of the succession of its nucleotides or amino acids respectively.

Permanently cationic: The term "permanently cationic" as used herein will be recognized and understood by the person of ordinary skill in the art, and means, for example, that the respective compound, or group or atom, is positively charged at any pH value or hydrogen ion activity of its environment. Typically, the positive charge is results from the presence of a quaternary nitrogen atom. Where a compound carries a plurality of such positive charges, it may be referred to as permanently polycationic, which is a subcategory of permanently cationic.

Pharmaceutically effective amount: The terms "pharmaceutically effective amount" or "effective amount" will be recognized and understood by the person of ordinary skill in the art, and are for example intended to refer to an amount of a compound (e.g. the artificial RNA of the invention) that is sufficient to induce a pharmaceutical effect, such as, in the context of the invention, an immune response (e.g. against an antigenic peptide, protein, polyprotein as defined herein).

Polyvalent/multivalent vaccine, polyvalent/multivalent composition: The terms "polyvalent vaccine", "polyvalent composition" "multivalent vaccine" or "multivalent composition" will be recognized and understood by the person of ordinary skill in the art, and are for example intended to refer to a composition or a vaccine comprising antigens from more than one strain of a virus, or comprising different antigens of the same virus, or any combination thereof. The terms describe that said vaccine or composition has more than one valence. In the context of the invention, a polyvalent RSV vaccine would comprise a vaccine comprising an artificial RNA encoding antigenic peptides or proteins derived from several different RSV strains or comprising artificial RNA encoding different antigens from the same RSV strain, or a combination thereof. In preferred embodiment, a polyvalent RSV vaccine or composition comprises more than one, preferably 2, 3, 4 or even more different artificial RNA species each encoding at least one different antigenic peptide or protein of RSV (e.g. RSV F and RSV M or RSV F and RSV N). Methods to produce polyvalent mRNA vaccines are disclosed in the PCT application PCT/EP2016/082487 or in published patent application WO2017/1090134A1.

Stabilized nucleic acid molecule" or "stabilized RNA: The term "stabilized nucleic acid molecule" or "stabilized RNA" refer to a nucleic acid molecule, preferably an RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule, e.g. stabilized RNA, in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

T-cell responses: The terms "cellular immunity" or "cellular immune response" or "cellular T-cell responses" as used herein will be recognized and understood by the person of ordinary skill in the art, and are for example intended to refer to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface. In the context of the invention, the antigen is provided by the artificial RNA encoding at least one antigenic peptide or protein derived from RSV, suitably inducing T-cell responses. The artificial RNA, the composition, the vaccine of the invention advantageously elicit cellular T-cell responses against RSV F antigens.

Variant (of a sequence): The term "variant" as used throughout the present specification in the context of a nucleic acid sequence will be recognized and understood by the person of ordinary skill in the art, and is for example intended to refer to a variant of nucleic acid sequences which forms the basis of a nucleic acid sequence. For example, a variant nucleic acid sequence may exhibit one or more nucleotide deletions, insertions, additions and/or substitutions compared to the nucleic acid sequence from which the variant is derived. Preferably, a variant of a nucleic acid sequence is at least 40%, preferably at least 50%, even preferably at least 60%, more preferably at least 70%, even more preferably at least 80%, even more preferably at least 90%, most preferably at least 95% identical to the nucleic acid sequence the variant is derived from. Preferably, the variant is a functional variant. A "variant" of a nucleic acid sequence may have at least 70%, 75%, 80%, 85%, 90%, 95%, 98% or 99% nucleotide identity over a stretch of 10, 20, 30, 50, 75 or 100 nucleotide of such nucleic acid sequence.

The term "variant" as used throughout the present specification in the context of proteins or peptides will be recognized and understood by the person of ordinary skill in the art, and is for example intended to refer to a proteins or peptide variant having an amino acid sequence which differs from the original sequence in one or more mutation(s), such as one or more substituted, inserted and/or deleted amino acid(s). Preferably, these fragments and/or variants have the same biological function or specific activity compared to the full-length native protein, e.g. its specific antigenic property. "Variants" of proteins or peptides as defined in the context of the present invention may comprise conservative amino acid substitution(s) compared to their native, i.e. non-mutated physiological, sequence. Those amino acid sequences as well as their encoding nucleotide sequences in particular fall under the term variants as defined herein. Substitutions in which amino acids, which originate from the same class, are exchanged for one another are called conservative substitutions. In particular, these are amino acids having aliphatic side chains, positively or negatively charged side chains, aromatic groups in the side chains or amino acids, the side chains of which can enter into hydrogen bridges, e.g. side chains which have a hydroxyl function. This means that e.g. an amino acid having a polar side chain is replaced by another amino acid having a likewise polar side chain, or, for example, an amino acid characterized by a hydrophobic side chain is substituted by another amino acid having a likewise hydrophobic side chain (e.g. serine (threonine) by threonine (serine) or leucine (isoleucine) by isoleucine (leucine)). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra). A "variant" of a protein or peptide may have at least 70%, 75%, 80%, 85%, 90%, 95%, 98% or 99% amino acid identity over a stretch of 10, 20, 30, 50, 75 or 100 amino acids of such protein or peptide. Preferably, a variant of a protein comprises a functional variant of the protein, which means that the variant exerts the same effect or functionality as the protein it is derived from.

3'-untranslated region, 3'-UTR element, 3'-UTR: The term "3'-untranslated region" or "3'-UTR element" will be recognized and understood by the person of ordinary skill in the art, and are for example intended to refer to a part of a nucleic acid molecule, which is located 3' (i.e. "downstream") of a coding sequence and which is typically not translated into protein. Usually, a 3'-UTR is the part of an mRNA which is located between the coding sequence (cds) and the poly(A) sequence of the mRNA. In the context of the invention, the term 3'-UTR may also comprise elements, which are not encoded in the DNA template, from which an artificial RNA is transcribed, but which are added after transcription during maturation, e.g. a poly(A) sequence.

5-untranslated region, 5'-UTR element, 5'-UTR: The term "5'-untranslated region (5'-UTR)" will be recognized and understood by the person of ordinary skill in the art, and are for example intended to refer to a part of a nucleic acid molecule, which is located 5' (i.e. "upstream") of a coding sequence and which is not translated into protein. A 5'-UTR is typically understood to be a particular section of messenger RNA (mRNA), which is located 5' of the coding sequence of the mRNA. Typically, the 5'-UTR starts with the transcriptional start site and ends one nucleotide before the start codon of the coding sequence. Preferably, the 5'-UTRs have a length of more than 20, 30, 40 or 50 nucleotides. The 5'-UTR may comprise elements for controlling gene expression, also called regulatory elements. Such regulatory elements may be, for example, ribosomal binding sites. The 5'-UTR may be post-transcriptionally modified, for example by addition of a 5'-cap.

5'-terminal oligopyrimidine tract (TOP). TOP-UTR: The term "5'-terminal oligopyrimidine tract (TOP)" has to be understood as a stretch of pyrimidine nucleotides located in the 5'-terminal region of a nucleic acid molecule, such as the 5'-terminal region of certain mRNA molecules or the 5'-terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3-30 or even more nucleotides. The pyrimidine stretch and thus the 5'-TOP ends one nucleotide 5' to the first purine nucleotide located downstream of the TOP. Messenger RNA that contains a 5'-terminal oligopyrimidine tract is often referred to as TOP mRNA. Accordingly, genes that provide such messenger RNAs are referred to as TOP genes. The term "TOP motif" or "5'-TOP motif" has to be understood as a nucleic acid sequence which corresponds to a 5'-TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'-end with a cytosine nucleotide. In TOP genes and TOP mRNAs, the TOP-motif preferably starts at its 5'-end with the transcriptional start site and ends one nucleotide 5' to the first purine residue in said gene or mRNA. A TOP motif in the sense of the present invention is preferably located at the 5'-end of a sequence which represents a 5'-UTR or at the 5'-end of a sequence which codes for a 5'-UTR. Thus, preferably, a stretch of 3 or more pyrimidine nucleotides is called "TOP motif" in the sense of the present invention if this stretch is located at the 5'-end of a respective sequence, such as the artificial nucleic acid, the 5'-UTR element of the artificial nucleic acid, or the nucleic acid sequence which is derived from the 5'-UTR of a TOP gene as described herein. In other words, a stretch of 3 or more pyrimidine nucleotides, which is not located at the 5'-end of a 5'-UTR or a 5'-UTR element but anywhere within a 5'-UTR or a 5'-UTR element, is preferably not referred to as "TOP motif". In some embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or RNA it is derived from. Thus, the 5'-UTR element does not comprise any part of the protein coding sequence. Thus, preferably, the only protein coding part of the at least one nucleic acid sequence, particularly of the RNA sequence, is provided by the coding sequence.

Short Description of the Invention

The present invention is based on the inventor's surprising finding that at least one peptide or protein derived from of a Respiratory syncytial virus (RSV) F protein encoded by the artificial RNA of the invention can efficiently be expressed in a mammalian cell. Even more unexpected, the inventors showed that the artificial RNA of the invention can induce specific functional and protective immune responses in e.g. cotton rats (see e.g. Example 2, 3). Through different optimizations in RSV F antigen design, the immune responses could be further improved. In addition, the expression of the RSV F antigen encoded by the artificial nucleic RNA could be increased by selecting suitable heterologous 5' untranslated regions (UTRs) and suitable heterologous 3' untranslated regions (UTRs) (see e.g. Example 4). Advantageously, said artificial RNA of the invention comprising advantageous 3'-UTR/5'-UTR combinations induce very efficient antigen-specific immune responses against the encoded RSV F. Further, artificial RNA of the invention comprised in lipid nanoparticles (LNPs) very efficiently induces antigen-specific immune responses against RSV F at a very low dosages and dosing regimen (see e.g. Example 3). Further, e.g. Example 8 and Example 12 provide compositions/vaccines comprising a further artificial RNA encoding a further antigen wherein said artificial RNA encoding a further antigen suitably elicits or enhances T-cell responses and results in a Th1-biased immune response, which is considered to be an important prerequisite for a potential RSV vaccine (Th2-biased responses have been associated with enhanced respiratory disease (ERD) in animal models). Furthermore the compositions are suitable to induce T-cell responses. Accordingly, the artificial RNA, and the composition/vaccine comprising said artificial RNA of the invention are suitable for eliciting an immune response against RSV F in a mammalian subject. The artificial RNA and the composition/vaccine comprising said artificial RNA is therefore suitable for use as a vaccine, e.g. as a human vaccine, e.g. as a vaccine for pregnant women or infants.

In a first aspect, the present invention provides an artificial nucleic acid, preferably an artificial RNA comprising at least one 5' untranslated region (UTR) and/or at least one 3' untranslated region (UTR), and at least one coding sequence operably linked to said 3'-UTR and/or 5'-UTR encoding at least one antigenic peptide or protein derived from RSV F protein or a fragment or variant thereof.

In preferred embodiments, the artificial RNA comprises at least one nucleic acid sequence derived from a 3'-UTR of a gene selected from an ALB7 gene, an alpha-globin gene, a PSMB3, CASP1, COX6B1, GNAS, NDUFA1 and RPS9, or from a homolog, a fragment or a variant of any one of these genes In preferred embodiments, the artificial RNA comprises at least one nucleic acid sequence derived from a 5'-UTR of gene selected from a RPL32 gene, a HSD17B4, ASAH1, ATP5A1, MP68, NDUFA4, NOSIP, RPL31, SLC7A3, TUBB4B and UBQLN2, or from a homolog, a fragment or variant of any one of these genes.

Suitably, the artificial RNA of the invention comprises at least one coding sequence encoding at least one antigenic peptide or protein derived from a RSV F protein operably linked to a 3'-UTR and a 5'-UTR selected from a-1 (HSD17B4/PSMB3), a-2 (Ndufa4/PSMB3), a-3 (SLC7A3/PSMB3), a-4 (NOSIP/PSMB3), a-5 (MP68/PSMB3), b-1 (UBQLN2/RPS9), b-2 (ASAH1/RPS9), b-3 (HSD17B4/RPS9), b-4 (HSD17B4/CASP1), b-5 (NOSIP/COX6B1), c-1 (NDUFA4/RPS9), c-2 (NOSIP/NDUFA1), c-3 (NDUFA4/COX6B1), c-4 (NDUFA4/NDUFA1), c-5 (ATP5A1/PSMB3), d-1 (Rpl31/PSMB3), d-2 (ATP5A1/CASP1), d-3 (SLC7A3/GNAS), d-4 (HSD17B4/NDUFA1), d-5 (Slc7a3/Ndufa1), e-1 (TUBB4B/RPS9), e-2 (RPL31/RPS9), e-3 (MP68/RPS9), e-4 (NOSIP/RPS9), e-5 (ATP5A1/RPS9), e-6 (ATP5A1/COX6B1), f-1 (ATP5A1/GNAS), f-2 (ATP5A1/NDUFA1), f-3 (HSD17B4/COX6B1), f-4 (HSD17B4/GNAS), f-5 (MP68/COX6B1), g-1 (MP68/NDUFA1), g-2 (NDUFA4/CASP1), g-3 (NDUFA4/GNAS), g-4 (NOSIP/CASP1), g-5 (RPL31/CASP1), h-1 (RPL31/COX6B1), h-2 (RPL31/GNAS), h-3 (RPL31/NDUFA1), h-4 (Slc7a3/CASP1), h-5 (SLC7A3/COX6B1), i-1 (SLC7A3/RPS9), i-2 (RPL32/ALB7), or i-3 (α-globin gene), wherein a-1 (HSD17B4/PSMB3), a-4 (NDUFA4/PSMB3), c-1 (NDUFA4/RPS9), e-4 NOSIP/RPS9), g-2 (NDUFA4/CASP1), i-2 (RPL32/ALB7), or i-3 (alpha-globin) are particularly preferred.

The at least one antigenic peptide or protein derived from RSV F protein may be a full-length F protein (referred to as "F0", aa 1-574) or an F protein with deleted C-terminus (referred to as "F-del", aa 1-553), or a fragment or a variant thereof.

The at least one antigenic peptide or protein may additionally comprise a mutation that stabilizes the antigen in pre-conformation state/pre-fusion conformation, preferably a DSCav1 mutation (S155C, S290C, S190F, and V207L) or a fragment or a variant, or a functional variant thereof (referred to as "DSCav1", e.g. "F0_DSCav1" or "F-del_DSCav1").

The at least one antigenic peptide or protein may be a fusion protein comprising the two subunits, F1 and F2 of mature F into a single chain, connected via a linker (GS) to enhance stability of the protein (F(1-103)-GS-F(145-574); F(1-103)-GS-F(145-553)).

The protein comprising the two subunits of mature F into a single chain (referred to as "F2-linker-F1"), e.g. (F(1-103)-GS-F(145-574); F(1-103)-GS-F(145-553) may additionally comprise a DSCav1 mutation (herein referred to as "mut0").

The protein comprising the two subunits of mature F into a single chain (referred to as "F2-linker-F1") may additionally to the DSCav1 mutation comprise at least one further mutation that promotes inter-protomer disulphide bonds, wherein the mutations may be selected from (S46G, A149C, S215P, Y458C, K465Q; herein referred to as "mut1"), (S46G, E92D, A149C, S215P, Y458C, K465Q; herein referred to as "mut2"), or (S46G, N67I, E92D, A149C, S215P, Y458C, K465Q; herein referred to as "mut3"), (A149C, Y458C; herein referred to as "mut4"), (N183GC, N428C; herein referred to as "mut5"), (Q98C, Q361C, S46G, E92D, L95M, S215P, I217P, I221M, R429K, K465Q; herein referred to as "mut6"), (Q98C, Q361C, L95M, I221M, R429K; herein referred to as "mut7"), or (N183GC, N428C, S46G, N67I, E92D, S215P, K465Q; herein referred to as "mut8") or a fragment or a variant, or a functional variant thereof.

The at least one antigenic peptide or protein derived from RSV F protein encoded by the artificial RNA of the invention may be selected from F0, F-del, F0_DSCav1, F_DSCav1_mut1, F_DSCav1_mut2, F_DSCav1_mut3, F_DSCav1_mut4, F_DSCav1_mut5, F_DSCav1_mut6, F_DSCav1_mut7, F_DSCav1_mut8, F_DSCav1_mut0, F-del_DSCav1, F-del_DSCav1_mut1, F-del_DSCav1_mut2, F-del_DSCav1_mut3, F-del_DSCav1_mut4, F-del_DSCav1_mut5, F-del_DSCav1_mut6, F-del_DSCav1_mut7, F-del_DSCav1_mut8, F-del_DSCav1_mut0 are preferred.

The at least one coding sequence may encode at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 68, 483, 898, 1267, 1636, 2005, 2374, 2743, 3112, 3481, 3850, 4219, 4588, 4957, 5326, 5695, 6064, 6433, 6802, 7171, 7540, 7909, 8279-9683, 11726, 12095, 12464, 12833, 13940, 14309, 14678, 15047, 15416, 15785, 13202, 13571, 16154, 16523, 16892, 17261, 17630, 17999, 18368, 18737, 19106, 19475 or a fragment or variant of any of these sequences.

Preferably, the artificial RNA may comprise a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 69-77, 484-492, 899-906, 1268-1275, 1637-1644, 2006-2013, 2375-2382, 2744-2751, 3113-3120, 3482-3489, 3851-3858, 4220-4227, 4589-4596, 4958-4965, 5327-5334, 5696-5703, 6065-6072, 6434-6441, 6803-6810, 7172-7179, 7541-7548, 7910-7917, 21363-21384, 11727-11734, 12096-12103, 12465-12472, 12834-12841, 13941-13948, 14310-14317, 14679-14686, 15048-15055, 15417-15424, 15786-15793, 13203-13210, 13572-13579, 16155-16162, 16524-16531, 16893-16900, 17262-17269, 17631-17638, 18000-18007, 18369-18376, 18738-18745, 19107-19114, 19476-19483. 21389-21410 or a fragment or variant of any of these sequences.

The artificial RNA may comprise a codon modified coding sequence selected from C maximized coding sequence, CAI maximized coding sequence, human codon usage adapted coding sequence, G/C content modified coding sequence, and G/C optimized coding sequence, or any combination thereof.

The artificial RNA may be an mRNA, a viral RNA, self-replicating RNA, a circular RNA, or a replicon RNA. In preferred embodiments, the artificial RNA is an mRNA.

The artificial RNA, preferably mRNA, may further comprise at least one selected from a cap structure, a poly(A) sequence, a poly(C)sequence, a histone-stem loop, and/or a 3'-terminal sequence element.

The artificial RNA of the invention preferably comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 78-482, 11735-12094, 21415-21417, 21561-21563, 21489, 21490, 21635, 21636 or a fragment or variant of any of these (encoding F0), SEQ ID NOs: 493-897, 12104-12463, 21418-21420, 21564-21566, 21491, 21492, 21637, 21638 or a fragment or variant of any of these (encoding F-del), SEQ ID NOs: 907-1266, 12473-12832, 21421-21423, 21567-21569, 21493-21495, 21639-21641 or a fragment or variant of any of these (encoding F0_DSCav1), SEQ ID NOs: 1276-1635, 8278, 12842-13201, 21424-21426, 21570-21572, 21496-21498, 21642-21644 or a fragment or variant of any of these (encoding F-del_DSCav1), SEQ ID NOs: 1645-2004, 13949-14308, 21433-21435, 21579-21581, 21505-21507, 21651-21653 or a fragment or variant of any of these (encoding F_DSCav1_mut1), SEQ ID NOs: 2014-2373, 14318-14677, 21436-21438, 21582-21584, 21508-21510, 21654-21656 or a fragment or variant of any of these (encoding F-del_DSCav1_mut1), SEQ ID NOs: 2383-2742, 14687-15046, 21439-21441, 21585-21587, 21511-21513, 21657-21659 or a fragment or variant of any of these (encoding F_DSCav1_mut2), SEQ ID NOs: 2752-3111, 15056-15415, 21442-21444, 21588-21590, 21514-21516, 21660-21662 or a fragment or variant of any of these (encoding F-del_DSCav1_mut2), SEQ ID NOs: 3121-3480, 15425-15784, 21445-21447, 21591-21593, 21517-21519, 21663-21665 or a fragment or variant of any of these (encoding F_DSCav1_mut3), SEQ ID NOs: 3490-3849, 15794-16153, 21448-21450, 21594-21596, 21520-21522, 21666-21668 or a fragment or variant of any of these (encoding F-del_DSCav1_mut3), SEQ ID NOs: 3859-4218, 13211-13570, 21427-21429, 21573-21575, 21499-21501, 21645-21647 or a fragment or variant of any of these (encoding F_DSCav1_mut0), SEQ ID NOs: 4228-4587, 13580-13939, 21430-21432, 21576-21578, 21502-21504, 21648-21650 or a fragment or variant of any of these (encoding F-del_DSCav1_mut0), SEQ ID NOs: 4597-4956, 16163-16522, 21451-21453, 21597-21599, 21523-21525, 21669-21671 or a fragment or variant of any of these (encoding F_DSCav1_mut4), SEQ ID NOs: 4966-5325, 16532-16891, 21454-21456, 21600-21602, 21526-21528, 21672-21674 or a fragment or variant of any of these (encoding F-del_DSCav1_mut4), SEQ ID NOs: 5335-5694, 16901-17260, 21457-21459, 21603-21605, 21529-21531, 21675-21677 or a fragment or variant of any of these (encoding F_DSCav1_mut5), SEQ ID NOs: 5704-6063, 17270-17629, 21460-21462, 21606-21608, 21532-21534, 21678-21680 or a fragment or variant of any of these (encoding F-del_DSCav1_mut5), SEQ ID NOs: 6073-6432, 17639-17998, 21463-21465, 21609-21611, 21535-21537, 21681-21683 or a fragment or variant of any of these (encoding F_DSCav1_mut6), SEQ ID NOs: 6442-6801, 18008-18367, 21466-21468, 21612-21614, 21538-21540, 21684-21686 or a fragment or variant of any of these (encoding F-del_DSCav1_mut6), SEQ ID NOs: 6811-7170, 18377-18736, 21469-21471, 21615-21617, 21541-21543, 21687-21689 or a fragment or variant of any of these (encoding F_DSCav1_mut7), SEQ ID NOs: 7180-7539, 18746-19105, 21472-21474, 21618-21620, 21544-21546, 21690-21692 or a fragment or variant of any of these (encoding F-del_DSCav1_mut7), SEQ ID NOs: 7549-7908, 19115-19474, 21475-21477, 21621-21623, 21547-21549, 21693-21695 or a fragment or variant of any of these (encoding F_DSCav1_mut8), or SEQ ID NOs: 7918-8277, 19484-19843, 21478-21480, 21624-21626, 21550-21552, 21696-21698 or a fragment or variant of any of these (encoding F-del_DSCav1_mut8).

In a second aspect, the present invention provides a composition comprising the artificial RNA of the first aspect.

In preferred embodiments, the composition comprising the artificial RNA of the first aspect comprises at least one further artificial RNA comprising at least one coding sequence encoding at least one antigenic peptide or protein derived from RSV selected from matrix protein M, nucleoprotein N, M2-1 protein, and/or phosphoprotein P or combinations thereof.

Matrix protein M, nucleoprotein N, M2-1 protein, M2-2 protein, and/or phosphoprotein P are suitable T-cell antigens and may promote efficient T-cell responses of the composition or vaccine when administered to a subject.

The further artificial RNA may comprise a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 9685-9692, 10135-10142, 10638-10645, 11184-11191, 21385-21388, 19845-19852, 20214-20221, 20583-20590, 20952-20959, 21411-21414 or a fragment or variant of any of these sequences.

Suitably, said further artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 9693-10052, 10143-10502, 10646-11005, 11192-11551, 19853-20212, 20222-20581, 20591-20950, 20960-21319, 21481-21488, 21627-21634, 21553-21560, 21699-21706 or a fragment or variant of any of these sequences.

Suitably, the composition may comprise the artificial RNA of the invention complexed with, encapsulated in, or associated with one or more lipids, thereby forming lipid nanoparticles.

The composition may preferably comprise the artificial RNA of the invention complexed with one or more lipids thereby forming lipid nanoparticles (LNP), wherein the LNP essentially consists of
  (i) at least one cationic lipid as defined herein, preferably a lipid of formula (III), more preferably lipid III-3;
  (ii) a neutral lipid as defined herein, preferably 1,2-distearoyl-sn-glycero-3-phosphocholine (DSPC);
  (iii) a steroid or steroid analogue as defined herein, preferably cholesterol; and
  (iv) a PEG-lipid as defined herein, e.g. PEG-DMG or PEG-cDMA, preferably a PEGylated lipid of formula (IVa);
  wherein (i) to (iv) are in a molar ratio of about 20-60% cationic lipid: 5-25% neutral lipid: 25-55% sterol; 0.5-15% PEG-lipid.

The present invention also concerns a RSV vaccine comprising said artificial RNA or said composition.

The present invention is also directed to the use of the artificial RNA, the composition and the vaccine in treatment or prophylaxis of an infection with RSV.

In particular, the present invention is directed to the use of the artificial RNA, the composition and the vaccine in treatment or prophylaxis of an infection with RSV or a disorder related to such an infection.

The invention further concerns a method of treating or preventing a disorder or a disease in a subject, first and second medical uses of the artificial RNA, compositions and vaccines. Further, the invention is directed to a kit, particularly to a kit of parts, comprising the artificial RNA, compositions and vaccines.

DETAILED DESCRIPTION OF THE INVENTION

The present application is filed together with a sequence listing in electronic format, which is part of the description of the present application (WIPO standard ST.25). The information contained in the electronic format of the sequence listing filed together with this application is incorporated herein by reference in its entirety. Where reference is made herein to a "SEQ ID NO" the corresponding nucleic acid sequence or amino acid (aa) sequence in the sequence listing having the respective identifier is referred to. For many sequences, the sequence listing also provides additional detailed information, e.g. regarding certain structural features, sequence optimizations, GenBank identifiers, or additional detailed information regarding its coding capacity. In particular, such information is provided under numeric identifier <223> in the WIPO standard ST.25 sequence listing. Accordingly, information provided under said numeric identifier <223> is explicitly included herein in its entirety and has to be understood as integral part of the description of the underlying invention.

Artificial Nucleic Acid

In a first aspect, the invention relates to an artificial nucleic acid comprising
  a) at least one heterologous 5' untranslated region (5'-UTR) and/or at least one heterologous 3' untranslated region (3'-UTR); and
  b) at least one coding sequence operably linked to said 3'-UTR and/or 5'-UTR encoding at least one antigenic peptide or protein derived from a Respiratory syncytial virus (RSV) or a fragment or variant thereof.

In a preferred embodiment of the first aspect, the invention relates to an artificial RNA, preferably an RNA suitable for vaccination, comprising
  a) at least one heterologous 5' untranslated region (5'-UTR) and/or at least one heterologous 3' untranslated region (3'-UTR); and
  b) at least one coding sequence operably linked to said 3'-UTR and/or 5'-UTR encoding at least one antigenic peptide or protein derived from a RSV fusion (F) protein or a fragment or variant thereof.

In general, the RNA of the invention may be composed of a protein-coding region, and 5'- and/or 3'-untranslated regions (UTRs). The 3'-UTR is variable in sequence and size; it spans between the stop codon and the poly(A) tail. Importantly, the 3'-UTR sequence harbors several regulatory motifs that determine RNA turnover, stability and localization, and thus governs many aspects of post-transcriptional regulation. In medical application of RNA (e.g. immunotherapy applications, vaccination) the regulation of RNA translation into protein is of paramount importance to therapeutic safety and efficacy. The present inventors surprisingly discovered that certain combinations of 3'-UTRs and/or 5'-UTRs act in concert to synergistically enhance the expression of operably linked nucleic acid sequences encoding RSV antigenic peptides or proteins. Artificial RNA molecules harboring the inventive UTR combinations advantageously enable the rapid and transient expression of high amounts of RSV antigenic peptides or proteins derived from RSV F. Accordingly, the artificial RNA provided herein is particularly useful and suitable for various applications in vivo, including the vaccination against RSV.

Suitably, the artificial RNA may comprise at least one heterologous 5'-UTR and/or at least one heterologous 3'-UTR. In this context, an UTR of the invention comprises or consists of a nucleic acid sequence derived from a 5'-UTR or a 3'-UTR of any naturally occurring gene or a fragment, a homolog or a variant thereof. Preferably, a 5'-UTR or a 3'-UTR of the invention is heterologous to the at least one coding sequence encoding the at least one antigenic peptide or protein derived from RSV F. Suitable heterologous 5'-UTRs or heterologous 3'-UTRs are derived from naturally occurring genes (that are not derived from RSV). In other embodiments, synthetically engineered 5'-UTRs or 3'-UTRs may be used in the context of the present invention.

In preferred embodiments, the at least one artificial RNA comprises at least one heterologous 3'-UTR.

Preferably, the at least one heterologous 3'-UTR comprises or consists of a nucleic acid sequence derived from a 3'-UTR of a chordate gene, preferably a vertebrate gene, more preferably a mammalian gene, most preferably a human gene, or from a variant of a 3'-UTR of a chordate gene, preferably a vertebrate gene, more preferably a mammalian gene, most preferably a human gene.

Preferably the artificial RNA of the present invention comprises a 3'-UTR, which may be derivable from a gene that relates to an RNA with an enhanced half-life (that provides a stable RNA), for example a 3'-UTR as defined and described below.

Preferably, the at least one heterologous 3'-UTR comprises a nucleic acid sequence derived from a 3'-UTR of a gene, which preferably encodes a stable mRNA, or from a homolog, a fragment or a variant of said gene.

In preferred embodiments of the first aspect, the artificial RNA of the invention comprises at least one heterologous 3'-UTR, wherein the at least one heterologous 3'-UTR comprises a nucleic acid sequence derived from a 3'-UTR of a gene selected from PSMB3, ALB7, alpha-globin (referred to as "muag"), CASP1, COX6B1, GNAS, NDUFA1 and RPS9, or from a homolog, a fragment or variant of any one of these genes.

ALB7-derived 3'-UTR: In preferred embodiments, the 3'-UTR comprises or consists of a nucleic acid sequence which is derived from the 3'-UTR of a vertebrate albumin gene or from a variant thereof, preferably from the 3'-UTR of a mammalian albumin gene or from a variant thereof, more preferably from the 3'-UTR of a human albumin gene or from a variant thereof, even more preferably from the 3'-UTR of the human albumin gene according to GenBank Accession number NM_000477.5, or from a homolog, fragment or variant thereof. Accordingly, the artificial RNA of the invention may comprise a 3'-UTR derived from a ALB7 gene, wherein said 3'-UTR derived from a ALB7 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 35 or 36 or a fragment or a variant thereof.

Alpha-globin gene-derived 3'-UTR: In preferred embodiments, the 3'-UTR comprises or consists of a nucleic acid sequence which is derived from the 3'-UTR of a vertebrate alpha-globin gene (referred to as "muag") or from a variant thereof, preferably from the 3'-UTR of a mammalian alpha-globin or from a variant thereof, more preferably from the 3'-UTR of a human alpha-globin gene or from a variant thereof, even more preferably from the 3'-UTR of the human alpha-globin gene. Accordingly, the RNA of the invention may comprise a 3'-UTR derived from a alpha-globin gene, wherein said 3'-UTR derived from a alpha-globin gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 37 or 38 or a fragment or a variant thereof.

PSMB3-derived 3'-UTR: The artificial RNA of the invention may comprise a 3'-UTR which is derived from a 3'-UTR of a gene encoding a proteasome subunit beta type-3 (PSMB3) protein, or a homolog, variant, fragment or derivative thereof. Such 3'-UTRs preferably comprise or consist of a nucleic acid sequences derived from the 3'-UTR of a proteasome subunit beta type-3 (PSMB3) gene, preferably from a vertebrate, more preferably a mammalian, most preferably a human proteasome subunit beta type-3 (PSMB3) gene, or a homolog, variant, fragment or derivative thereof. Said gene may preferably encode a proteasome subunit beta type-3 (PSMB3) protein corresponding to a human proteasome subunit beta type-3 (PSMB3) protein (UniProt Ref. No. P49720, entry version #183 of 30 Aug. 2017). Accordingly, the artificial RNA of the invention may comprise a 3'-UTR derived from a PSMB3 gene, wherein said 3'-UTR derived from a PSMB3 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 23 or 24 or a fragment or a variant thereof.

CASP1-derived 3'-UTR: The artificial RNA of the invention may comprise a 3'-UTR which is derived from a 3'-UTR of a gene encoding a Caspase-1 (CASP1) protein, or a homolog, variant, fragment or derivative thereof. Such 3'-UTRs preferably comprise or consist of a nucleic acid sequence derived from the 3'-UTR of a Caspase-1 (CASP1) gene, preferably from a vertebrate, more preferably a mammalian, most preferably a human Caspase-1 (CASP1) gene, or a homolog, variant, fragment or derivative thereof. Accordingly, the RNA of the invention may comprise a 3'-UTR derived from a CASP1 gene, wherein said 3'-UTR derived from a CASP1 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 25 or 26 or a fragment or a variant thereof.

COX6B1-derived 3'-UTR: The artificial RNA of the invention may comprise a 3'-UTR which is derived from a 3'-UTR of a COX6B1 gene encoding a cytochrome c oxidase subunit 6B1 (COX6B1) protein, or a homolog, variant, fragment or derivative thereof. Such 3'-UTRs preferably comprise or consist of a nucleic acid sequence which is derived from the 3'-UTR of a cytochrome c oxidase subunit 6B1 (COX6B1) gene, preferably from a vertebrate, more preferably a mammalian, most preferably a human cytochrome c oxidase subunit 6B1 (COX6B1) gene, or a homolog, variant, fragment or derivative thereof. Said gene may preferably encode a cytochrome c oxidase subunit 6B1 (COX6B1) protein corresponding to a human cytochrome c oxidase subunit 6B1 (COX6B1) protein (UniProt Ref. No. P14854, entry version #166 of 30 Aug. 2017). Accordingly, the artificial RNA of the invention may comprise a 3'-UTR derived from a COX6B1 gene, wherein said 3'-UTR derived from a COX6B1 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 27 or 28 or a fragment or a variant thereof.

GNAS-derived 3'-UTR: The artificial RNA of the invention may comprise a 3'-UTR which is derived from a 3'-UTR of a GNAS gene encoding a Guanine nucleotide-binding protein G(s) subunit alpha isoforms short (GNAS) protein, or a homolog, variant, fragment or derivative thereof. Such 3'-UTRs preferably comprise or consist of a nucleic acid sequence which is derived from the 3'-UTR of a Guanine nucleotide-binding protein G(s) subunit alpha isoforms short (GNAS) gene, preferably from a vertebrate, more preferably a mammalian Guanine nucleotide-binding protein G(s) subunit alpha isoforms short (GNAS) gene, or a homolog, variant, fragment or derivative thereof. Said gene may preferably encode a Guanine nucleotide-binding protein G(s) subunit alpha isoforms short (GNAS) protein corresponding to a human Guanine nucleotide-binding protein G(s) subunit alpha isoforms short (GNAS) protein (UniProt Ref. No. P63092, entry version #153 of 30 Aug. 2017). Accordingly, the artificial RNA of the invention may comprise a 3'-UTR derived from a GNAS gene, wherein said 3'-UTR derived from a GNAS gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 29 or 30 or a fragment or a variant thereof.

NDUFA1-derived 3'-UTR: The artificial RNA of the invention may comprise a 3'-UTR which is derived from a 3'-UTR of a gene encoding a NADH dehydrogenase [ubiquinone] 1 alpha sub complex subunit 1 (NDUFA1) protein, or a homolog, variant, fragment or derivative thereof. Such 3'-UTRs preferably comprise or consist of a nucleic acid sequence derived from the 3'-UTR of a NADH dehydrogenase [ubiquinone] 1 alpha sub complex subunit 1 (NDUFA1) gene, preferably from a vertebrate, more preferably a mammalian NADH dehydrogenase [ubiquinone]1 alpha sub complex subunit 1 (NDUFA1) gene, or a homolog, variant, fragment or derivative thereof. Said gene may preferably encode a NADH dehydrogenase [ubiquinone] 1 alpha sub complex subunit 1 (NDUFA1) protein corresponding to a human NADH dehydrogenase [ubiquinone] 1 alpha sub complex subunit 1 (NDUFA1) protein (UniProt Ref. No. 015239, entry version #152 of 30 Aug. 2017). Accordingly, the artificial RNA of the invention may comprise a 3'-UTR derived from a NDUFA1 gene, wherein said 3'-UTR derived from a NDUFA1 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 31 or 32 or a fragment or a variant thereof.

RPS9-derived 3'-UTR: The artificial RNA of the invention may comprise a 3'-UTR which is derived from a 3'-UTR of a gene encoding a 40S ribosomal protein S9 (RPS9) protein, or a homolog, variant, fragment or derivative thereof. Such 3'-UTRs preferably comprise or consist of a nucleic acid sequence derived from the 3'-UTR of a 40S ribosomal protein S9 (RPS9) gene, preferably from a vertebrate, more preferably a mammalian, most preferably a human 40S ribosomal protein S9 (RPS9) gene, or a homolog, variant, fragment or derivative thereof. Said gene may preferably encode a 40S ribosomal protein S9 (RPS9) protein corresponding to a human 40S ribosomal protein S9 (RPS9) protein (UniProt Ref. No. P46781, entry version #179 of 30 Aug. 2017). Accordingly, the artificial RNA of the invention may comprise a 3'-UTR derived from a RPS9 gene, wherein said 3'-UTR derived from a RPS9 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 33 or 34 or a fragment or a variant thereof.

Further 3'-UTRs: In embodiments, the artificial RNA as defined herein comprises a 3'-UTR as described in WO2016/107877. In this context, the disclosure of WO2016/107877 relating to 3'-UTR sequences is herewith incorporated by reference. Particularly suitable 3'-UTRs are SEQ ID NOs: 1 to 24 and SEQ ID NOs: 49 to 318 of patent application WO2016/107877, or fragments or variants of these sequences. Accordingly, the 3'-UTRs of the artificial RNA of the present invention may comprise or consists of a corresponding RNA sequence of the nucleic acid sequence according SEQ ID NOs: 1 to 24 and SEQ ID NOs: 49 to 318 of the patent application WO2016/107877. In other embodiments, the artificial RNA as defined herein comprises a 3'-UTR as described in WO2017/036580. In this context, the disclosure of WO2017/036580 relating to 3'-UTR sequences is herewith incorporated by reference. Particularly suitable 3'-UTRs are SEQ ID NOs: 152 to 204 of the patent application WO2017/036580, or fragments or variants of these sequences. Accordingly, the 3'-UTR of the artificial RNA of the present invention may comprise or consist of a corresponding RNA sequence of the nucleic acid sequence according SEQ ID NOs: 152 to 204 of the patent application WO2017/036580.

According to preferred embodiments the artificial RNA comprises at least one heterologous 5'-UTR.

In preferred embodiments, the at least one artificial nucleic acid as defined herein, particularly the RNA as defined herein may comprise at least one heterologous 5'-UTR.

Preferably, the at least one 5'-UTR comprises or consists of a nucleic acid sequence derived from the 5'-UTR of a chordate gene, preferably a vertebrate gene, more preferably a mammalian gene, most preferably a human gene, or from a variant of the 5'-UTR of a chordate gene, preferably a vertebrate gene, more preferably a mammalian gene, most preferably a human gene.

Preferably the artificial RNA of the present invention comprises a 5'-UTR, which may be derivable from a gene that relates to an RNA with an enhanced half-life (that provides a stable RNA), for example a 5'-UTR as defined and described below.

Preferably, the at least one heterologous 5'-UTR comprises a nucleic acid sequence derived from a 5'-UTR of a gene, which preferably encodes a stable mRNA, or from a homolog, a fragment or a variant of said gene.

In preferred embodiments of the first aspect, the artificial RNA of the invention comprises at least one heterologous 5'-UTR, wherein the at least one heterologous 5'-UTR comprises a nucleic acid sequence derived from a 5'-UTR of gene selected from HSD17B4, RPL32, ASAH1, ATP5A1, MP68, NDUFA4, NOSIP, RPL31, SLC7A3, TUBB4B, and UBQLN2, or from a homolog, a fragment or variant of any one of these genes.

RPL32-derived 5'-UTR: The artificial RNA of the invention may comprise a 5'-UTR derived from a 5'-UTR of a gene encoding a 60S ribosomal protein L32, or a homolog, variant, fragment or derivative thereof, wherein said 5'-UTR preferably lacks the 5'TOP motif. Such 5'-UTRs preferably comprise or consist of a nucleic acid sequence derived from the 5'-UTR of a 60S ribosomal protein L32 (RPL32) gene, preferably from a vertebrate, more preferably a mammalian, most preferably a human 60S ribosomal protein L32 (RPL32) gene, or a homolog, variant, fragment or derivative thereof, wherein the 5'-UTR preferably does not comprise the 5'TOP of said gene. Said gene may preferably encode a 60S ribosomal protein L32 (RPL32) corresponding to a human 60S ribosomal protein L32 (RPL32) (UniProt Ref. No. P62899, entry version #138 of 30 Aug. 2017). Accordingly, the artificial RNA of the invention may comprise a 5'-UTR derived from a RPL32 gene, wherein said 5'-UTR derived from a RPL32 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 21 or 22 or a fragment or a variant thereof.

HSD17B4-derived 5'-UTR: The artificial RNA of the invention may comprise a 5'-UTR derived from a 5'-UTR of a gene encoding a 17-beta-hydroxysteroid dehydrogenase 4, or a homolog, variant, fragment or derivative thereof, preferably lacking the 5'TOP motif. Such 5'-UTRs preferably comprise or consist of a nucleic acid sequence derived from the 5'-UTR of a 17-beta-hydroxysteroid dehydrogenase 4 (also referred to as peroxisomal multifunctional enzyme type 2) gene, preferably from a vertebrate, more preferably mammalian, most preferably human 17-beta-hydroxysteroid dehydrogenase 4 (HSD17B4) gene, or a homolog, variant, fragment or derivative thereof, wherein preferably the 5'-UTR does not comprise the 5'TOP of said gene. Said gene may preferably encode a 17-beta-hydroxysteroid dehydrogenase 4 protein corresponding to human 17-beta-hydroxysteroid dehydrogenase 4 (UniProt Ref. No. Q9BPX1, entry version #139 of Aug. 30, 2017), or a homolog, variant, fragment or derivative thereof. Accordingly, the artificial RNA of the invention may comprise a 5'-UTR derived from a HSD17B4 gene, wherein said 5'-UTR derived from a HSD17B4 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 1 or 2 or a fragment or a variant thereof.

ASAH1-derived 5'-UTR: The artificial RNA of the invention may comprise a 5'-UTR derived from a 5'-UTR of a gene encoding acid ceramidase (ASAH1), or a homolog, variant, fragment or derivative thereof. Such 5'-UTRs preferably comprise or consist of a nucleic acid sequence derived from the 5'-UTR of an acid ceramidase (ASAH1) gene, preferably from a vertebrate, more preferably mammalian, most preferably human acid ceramidase (ASAH1) gene, or a homolog, variant, fragment or derivative thereof. Said gene may preferably encode an acid ceramidase (ASAH1) protein corresponding to human acid ceramidase (ASAH1) (UniProt Ref. No. Q13510, entry version #177 of Jun. 7, 2017), or a homolog, variant, fragment or derivative thereof. Accordingly, the artificial RNA of the invention may comprise a 5'-UTR derived from a ASAH1 gene, wherein said 5'-UTR derived from a ASAH1 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 3 or 4 or a fragment or a variant thereof.

ATP5A1-derived 5'-UTR: The artificial RNA of the invention may comprise a 5'-UTR which is derived from a 5'-UTR of a gene encoding mitochondrial ATP synthase subunit alpha (ATP5A1), or a homolog, variant, fragment or derivative thereof, wherein said 5'-UTR preferably lacks the 5'TOP motif. Such 5'-UTRs preferably comprise or consist of a nucleic acid sequence derived from the 5'-UTR of a mitochondrial ATP synthase subunit alpha (ATP5A1) gene, preferably from a vertebrate, more preferably a mammalian and most preferably a human mitochondrial ATP synthase subunit alpha (ATP5A1) gene, or a homolog, variant, fragment or derivative thereof, wherein the 5'-UTR preferably does not comprise the 5'TOP of said gene. Said gene may preferably encode a mitochondrial ATP synthase subunit alpha protein corresponding to human acid mitochondrial ATP synthase subunit alpha (UniProt Ref. No. P25705, entry version #208 of Aug. 30, 2017), or a homolog, variant, fragment or derivative thereof. Accordingly, the artificial RNA of the invention may comprise a 5'-UTR derived from a ATP5A1 gene, wherein said 5'-UTR derived from a ATP5A1 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 5 or 6 or a fragment or a variant thereof.

MP68-derived 5'-UTR: The artificial RNA of the invention may comprise a 5'-UTR which is derived from a 5'-UTR of a gene encoding MP68, or a homolog, fragment or variant thereof. Such 5'-UTRs preferably comprise or consist of a nucleic acid sequence derived from the 5'-UTR of a 6.8 kDa mitochondrial proteolipid (MP68) gene, preferably from a vertebrate, more preferably a mammalian 6.8 kDa mitochondrial proteolipid (MP68) gene, or a homolog, variant, fragment or derivative thereof. Said gene may preferably encode a 6.8 kDa mitochondrial proteolipid (MP68) protein corresponding to a human 6.8 kDa mitochondrial proteolipid (MP68) protein (UniProt Ref. No. P56378, entry version #127 of 15 Feb. 2017). Accordingly, the artificial RNA of the invention may comprise a 5'-UTR derived from a MP68 gene, wherein said 5'-UTR derived from a MP68 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 7 or 8 or a fragment or a variant thereof.

NDUFA4-derived 5'-UTR: The artificial RNA of the invention may comprise a 5'-UTR which is derived from a 5'-UTR of a gene encoding a Cytochrome c oxidase subunit (NDUFA4), or a homolog, fragment or variant thereof. Such 5'-UTRs preferably comprise or consist of a nucleic acid sequence derived from the 5'-UTR of a Cytochrome c oxidase subunit (NDUFA4) gene, preferably from a vertebrate, more preferably a mammalian Cytochrome c oxidase subunit (NDUFA4) gene, or a homolog, variant, fragment or derivative thereof. Said gene may preferably encode a Cytochrome c oxidase subunit (NDUFA4) protein corresponding to a human Cytochrome c oxidase subunit (NDUFA4) protein (UniProt Ref. No. 000483, entry version #149 of 30 Aug. 2017). Accordingly, the artificial RNA of the invention may comprise a 5'-UTR derived from a NDUFA4 gene, wherein said 5'-UTR derived from a NDUFA4 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 9 or 10 or a fragment or a variant thereof.

NOSIP-derived 5'-UTR: The artificial RNA of the invention may comprise a 5'-UTR which is derived from a 5'-UTR of a gene encoding a Nitric oxide synthase-interacting (NOSIP) protein, or a homolog, variant, fragment or derivative thereof. Such 5'-UTRs preferably comprise or consist of a nucleic acid sequence derived from the 5'-UTR of a Nitric oxide synthase-interacting protein (NOSIP) gene, preferably from a vertebrate, more preferably a mammalian, most preferably a human Nitric oxide synthase-interacting protein (NOSIP) gene, or a homolog, variant, fragment or derivative thereof. Said gene may preferably encode a Nitric oxide synthase-interacting protein (NOSIP) protein corresponding to a human Nitric oxide synthase-interacting protein (NOSIP) protein (UniProt Ref. No. Q9Y314, entry version #130 of 7 Jun. 2017). Accordingly, the artificial RNA of the invention may comprise a 5'-UTR derived from a NOSIP gene, wherein said 5'-UTR derived from a NOSIP gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 11 or 12 or a fragment or a variant thereof.

RPL31-derived 5'-UTR: The artificial RNA of the invention may comprise a 5'-UTR which is derived from a 5'-UTR of a gene encoding a 60S ribosomal protein L31, or a homolog, variant, fragment or derivative thereof, wherein said 5'-UTR preferably lacks the 5'TOP motif. Such 5'-UTR preferably comprise or consist of a nucleic acid sequence derived from the 5'-UTR of a 60S ribosomal protein L31 (RPL31) gene, preferably from a vertebrate, more preferably a mammalian60S ribosomal protein L31 (RPL31) gene, or a homolog, variant, fragment or derivative thereof, wherein the 5'-UTR preferably does not comprise the 5'TOP of said gene. Said gene may preferably encode a 60S ribosomal protein L31 (RPL31) corresponding to a human 60S ribosomal protein L31 (RPL31) (UniProt Ref. No. P62899, entry version #138 of 30 Aug. 2017). Accordingly, the artificial RNA of the invention may comprise a 5'-UTR derived from a RPL31 gene, wherein said 5'-UTR derived from a RPL31 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 13 or 14 or a fragment or a variant thereof.

SLC7A3-derived 5'-UTR: The artificial RNA of the invention may comprise a 5'-UTR which is derived from a 5'-UTR of a gene encoding a cationic amino acid transporter 3 (solute carrier family 7 member 3, SLC7A3) protein, or a homolog, variant, fragment or derivative thereof. Such 5'-UTRs preferably comprise or consist of a nucleic acid sequence derived from the 5'-UTR of a cationic amino acid transporter 3 (SLC7A3) gene, preferably from a vertebrate, more preferably a mammalian cationic amino acid transporter 3 (SLC7A3) gene, or a homolog, variant, fragment or derivative thereof. Said gene may preferably encode a cationic amino acid transporter 3 (SLC7A3) protein corresponding to a human cationic amino acid transporter 3 (SLC7A3) protein (UniProt Ref. No. Q8WY07, entry version #139 of 30 Aug. 2017). Accordingly, the artificial RNA of the invention may comprise a 5'-UTR derived from a SLC7A3 gene, wherein said 5'-UTR derived from a SLC7A3 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 15 or 16 or a fragment or a variant thereof.

TUBB4B-derived 5'-UTR: The artificial RNA of the invention may comprise a 5'-UTR which is derived from a 5'-UTR of a gene encoding a tubulin beta-4B chain (TUBB4B) protein, or a homolog, variant, fragment or derivative thereof. Such 5'-UTRs preferably comprise or consist of a nucleic acid sequence derived from the 5'-UTR of a tubulin beta-4B chain (TUBB4B) gene, preferably from a vertebrate, more preferably a mammalian and most preferably a human tubulin beta-4B chain (TUBB4B) gene, or a homolog, variant, fragment or derivative thereof. Said gene may preferably encode a tubulin beta-4B chain (TUBB4B) protein corresponding to human tubulin beta-4B chain (TUBB4B) protein (UniProt Ref. No. Q8WY07, entry version #142 of 30 Aug. 2017). Accordingly, the artificial RNA of the invention may comprise a 5'-UTR derived from a TUBB4B gene, wherein said 5'-UTR derived from a TUBB4B gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17 or 18 or a fragment or a variant thereof.

UBQLN2-derived 5'-UTR: The artificial RNA of the invention may comprise a 5'-UTR which is derived from a 5'-UTR of a gene encoding an ubiquilin-2 (UBQLN2) protein, or a homolog, variant, fragment or derivative thereof. Such 5'-UTRs preferably comprise or consist of a nucleic acid sequence derived from the 5'-UTR of an ubiquilin-2 (UBQLN2) gene, preferably from a vertebrate, more preferably a mammalian ubiquilin-2 (UBQLN2) gene, or a homolog, variant, fragment or derivative thereof. Said gene may preferably encode an ubiquilin-2 (UBQLN2) protein corresponding to UniProt Ref. No. Q9UHD9, entry version #151 of 30 Aug. 2017. Accordingly, the artificial RNA of the invention may comprise a 5'-UTR derived from a UBQLN2 gene, wherein said 5'-UTR derived from a UBQLN2 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 19 or 20 or a fragment or a variant thereof.

Further 5'-UTRs: In embodiments, the artificial RNA as defined herein comprises a 5'-UTR as described in WO2013/143700. In this context, the disclosure of WO2013/143700 relating to 5'-UTR sequences is herewith incorporated by reference. Particularly preferred 5'-UTRs are nucleic acid sequences derived from SEQ ID NOs: 1-1363, SEQ ID NO: 1395, SEQ ID NO: 1421 and SEQ ID NO: 1422 of the patent application WO2013/143700, or fragments or variants of these sequences. In this context, it is preferred that the 5'-UTR of the artificial RNA according to the present invention comprises or consists of a corresponding RNA sequence of the nucleic acid sequence according SEQ ID NOs: 1-1363, SEQ ID NO: 1395, SEQ ID NO: 1421 and SEQ ID NO: 1422 of the patent application WO2013/143700. In other embodiments, the artificial RNA of the invention comprises a 5'-UTR as described in WO2016/107877. In this context, the disclosure of WO2016/107877 relating to 5'-UTR sequences is herewith incorporated by reference. Particularly preferred 5'-UTRs are nucleic acid sequences according to SEQ ID NOs: 25 to 30 and SEQ ID NOs: 319 to 382 of the patent application WO2016/107877, or fragments or variants of these sequences. In this context, it is particularly preferred that the 5'-UTR of the artificial RNA comprises or consists of a corresponding RNA sequence of the nucleic acid sequence according SEQ ID NOs: 25 to 30 and SEQ ID NOs: 319 to 382 of the patent application WO2016/107877. In other embodiments, the artificial RNA of the invention comprises a 5'-UTR as described in WO2017/036580. In this context, the disclosure of WO2017/036580 relating to 5'-UTR sequences is herewith incorporated by reference. Particularly preferred 5'-UTRs are nucleic acid sequences according to SEQ ID NOs: 1 to 151 of the patent application WO2017/036580, or fragments or variants of these sequences. In this context, it is particularly preferred that the 5'-UTR of the artificial RNA comprises or consists of a corresponding RNA sequence of the nucleic acid sequence according to SEQ ID NOs: 1 to 151 of the patent application WO2017/036580.

The inventors observed that certain combinations of at least one heterologous 5'-UTR and/or at least one heterologous 3'-UTR are advantageously increasing the translation of the at least one coding sequence operably linked to said 3'-UTR and/or 5'-UTR encoding at least one antigenic peptide or protein derived from a RSV F protein in the target tissue (e.g., muscle, dermis).

Accordingly it is preferred that the at least one heterologous 5'-UTR as defined herein and the at least one heterologous 3'-UTR as defined herein act synergistically to increase production (that is translation) of antigenic peptide or protein from the artificial RNA of the invention. These advantageous combinations of 5'-UTR and 3'-UTR are specified in the following. Each of the abbreviation introduced below, namely "a-1", "a-2", "a-3", "a-4", "a-5", "b-1", "b-2", "b-3", "b-4", "b-5", "c-1", "c-2", "c-3", "c-4", "c-5", "d-1", "d-2", "d-3", "d-4", "d-5", "e-1", "e-2", "e-3", "e-4", "e-5", "e-6", "f-1", "f-2", "f-3", "f-4", "f-5", "g-1", "g-2", "g-3", "g-4", "g-5", "h-1", "h-2", "h-3", "h-4", "h-5", "i-1", "i-2", "i-3", are used throughout the specification of the present invention and represent one advantageous combination of 5'-UTR and/or 3'UTR of the invention.

Accordingly, in preferred embodiments of the first aspect, the artificial RNA of the invention comprises a-1. at least one 5'-UTR derived from a 5'-UTR of a HSD17B4 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or a-2. at least one 5'-UTR derived from a 5'-UTR of a NDUFA4 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or a-3. at least one 5'-UTR derived from a 5'-UTR of a SLC7A3 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or a-4. at least one 5'-UTR from a 5'-UTR of a NOSIP gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or a-5. at least one 5'-UTR derived from a 5'-UTR of a MP68 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or b-1. at least one 5'-UTR derived from a 5'-UTR of a UBQLN2 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or b-2. at least one 5'-UTR derived from a 5'-UTR of a ASAH1 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or b-3. at least one 5'-UTR derived from a 5'-UTR of a HSD17B4 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or b-4. at least one 5'-UTR derived from a 5'-UTR of a HSD17B4 gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or b-5. at least one 5'-UTR derived from a 5'-UTR of a NOSIP gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or c-1. at least one 5'-UTR derived from a 5'-UTR of a NDUFA4 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or c-2. at least one 5'-UTR derived from a 5'-UTR of a NOSIP gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or c-3. at least one 5'-UTR derived from a 5'-UTR of a NDUFA4 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or c-4. at least one 5'-UTR derived from a 5'-UTR of a NDUFA4 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or c-5. at least one 5'-UTR derived from a 5'-UTR of a ATP5A1 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or d-1. at least one 5'-UTR derived from a 5'-UTR of a RPL31 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or d-2. at least one 5'-UTR derived from a 5'-UTR of a ATP5A1 gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or d-3. at least one 5'-UTR derived from a 5'-UTR of a SLC7A3 gene, or from a corresponding RNA sequence, homolog, fragment or variant thereof and at least one 3'-UTR derived from a 3'-UTR of a GNAS gene, or from a corresponding RNA sequence, homolog, fragment or variant thereof; or d-4. at least one 5'-UTR derived from a 5'-UTR of a HSD17B4 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or d-5. at least one 5'-UTR derived from a 5'-UTR of a SLC7A3 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or e-1. at least one 5'-UTR derived from a 5'-UTR of a TUBB4B gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or e-2. at least one 5'-UTR derived from a 5'-UTR of a RPL31 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or e-3. at least one 5'-UTR derived from a 5'-UTR of a MP68 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or e-4. at least one 5'-UTR derived from a 5'-UTR of a NOSIP gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or e-5. at least one 5'-UTR derived from a 5'-UTR of a ATP5A1 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or e-6. at least one 5'-UTR derived from a 5'-UTR of a ATP5A1 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or f-1. at least one 5'-UTR derived from a 5'-UTR of a ATP5A1 gene, or from a corresponding RNA sequence, homolog, fragment or variant thereof and at least one 3'-UTR derived from a 3'-UTR of a GNAS gene, or from a corresponding RNA sequence, homolog, fragment or variant thereof; or f-2. at least one 5'-UTR derived from a 5'-UTR of a ATP5A1 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or f-3. at least one 5'-UTR derived from a 5'-UTR of a HSD17B4 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or f-4 at least one 5'-UTR derived from a 5'-UTR of a HSD17B4 gene, or from a corresponding RNA sequence, homolog, fragment or variant thereof and at least one 3'-UTR derived from a 3'-UTR of a GNAS gene, or from a corresponding RNA sequence, homolog, fragment or variant thereof; or f-5. at least one 5'-UTR derived from a 5'-UTR of a MP68 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or g-1. at least one 5'-UTR derived from a 5'-UTR of a MP68 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or g-2. at least one 5'-UTR derived from a 5'-UTR of a NDUFA4 gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or g-3. at least one 5'-UTR derived from a 5'-UTR of a NDUFA4 gene, or from a corresponding RNA sequence, homolog, fragment or variant thereof and at least one 3'-UTR derived from a 3'-UTR of a GNAS gene, or from a corresponding RNA sequence, homolog, fragment or variant thereof; or g-4. at least one 5'-UTR derived from a 5'-UTR of a NOSIP gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or g-5. at least one 5'-UTR derived from a 5'-UTR of a RPL31 gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or h-1. at least one 5'-UTR derived from a 5'-UTR of a RPL31 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or h-2. at least one 5'-UTR derived from a 5'-UTR of a RPL31 gene, or from a corresponding RNA sequence, homolog, fragment or variant thereof and at least one 3'-UTR derived from a 3'-UTR of a GNAS gene, or from a corresponding RNA sequence, homolog, fragment or variant thereof; or h-3. at least one 5'-UTR derived from a 5'-UTR of a RPL31 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or h-4. at least one 5'-UTR derived from a 5'-UTR of a SLC7A3 gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or h-5. at least one 5'-UTR derived from a 5'-UTR of a SLC7A3 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or i-1. at least one 5'-UTR derived from a 5'-UTR of a SLC7A3 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof.

i-2. at least one 5'-UTR derived from a 5'-UTR of a RPL32 gene, or from a corresponding RNA sequence, homolog, fragment or variant thereof and at least one 3'-UTR derived from a 3'-UTR of a ALB7 gene, or from a corresponding RNA sequence, homolog, fragment or variant thereof.

i-3. at least one 3'-UTR derived from a 3'-UTR of a alpha-globin gene gene, or from a corresponding RNA sequence, homolog, fragment or variant thereof.

Suitably, the artificial RNA of the invention comprises at least one coding sequence encoding at least one antigenic peptide or protein derived from a RSV F protein as specified herein operably linked to a 3'-UTR and a 5'-UTR selected from a-1 (HSD17B4/PSMB3), a-2 (Ndufa4/PSMB3), a-3 (SLC7A3/PSMB3), a-4 (NOSIP/PSMB3), a-5 (MP68/PSMB3), b-1 (UBQLN2/RPS9), b-2 (ASAH1/RPS9), b-3 (HSD17B4/RPS9), b-4 (HSD17B4/CASP1), b-5 (NOSIP/COX6B1), c-1 (NDUFA4/RPS9), c-2 (NOSIP/NDUFA1), c-3 (NDUFA4/COX6B1), c-4 (NDUFA4/NDUFA1), c-5 (ATP5A1/PSMB3), d-1 (Rpl31/PSMB3), d-2 (ATP5A1/CASP1), d-3 (SLC7A3/GNAS), d-4 (HSD17B4/NDUFA1), d-5 (Slc7a3/Ndufa1), e-1 (TUBB4B/RPS9), e-2 (RPL31/RPS9), e-3 (MP68/RPS9), e-4 (NOSIP/RPS9), e-5 (ATP5A1/RPS9), e-6 (ATP5A1/COX6B1), f-1 (ATP5A1/GNAS), f-2 (ATP5A1/NDUFA1), f-3 (HSD17B4/COX6B1), f-4 (HSD17B4/GNAS), f-5 (MP68/COX6B1), g-1 (MP68/NDUFA1), g-2 (NDUFA4/CASP1), g-3 (NDUFA4/GNAS), g-4 (NOSIP/CASP1), g-5 (RPL31/CASP1), h-1 (RPL31/COX6B1), h-2 (RPL31/GNAS), h-3 (RPL31/NDUFA1), h-4 (Slc7a3/CASP1), h-5 (SLC7A3/COX6B1), i-1 (SLC7A3/RPS9), i-2 (RPL32/ALB7), or i-3 (α-globin gene).

In particularly preferred embodiments of the first aspect, the artificial RNA of the invention comprise UTR elements according to a-1 (HSD17B4/PSMB3), a-4 (NDUFA4/PSMB3), c-1 (NDUFA4/RPS9), e-4 (NOSIP/RPS9), g-2 (NDUFA4/CASP1), i-2 (RPL32/ALB7), or i-3 (alpha-globin (muag)).

In a particularly preferred embodiment of the first aspect, the artificial RNA of the invention comprises UTR elements according to a-1 (HSD17B4/PSMB3).

The invention relates to an artificial RNA, preferably an RNA suitable for vaccination, comprising at least one heterologous 5'-UTR as defined above and/or at least one heterologous 3'-UTR as defined above and at least one coding sequence operably linked to said 3'-UTR and/or 5'-UTR, wherein said coding sequence encodes at least one antigenic peptide or protein derived from a Respiratory syncytial virus ("RSV"), or a fragment or variant thereof.

As used herein, the term "Respiratory syncytial virus" or the corresponding abbreviation "RSV" is not limited to a particular virus strain, variant, serotype, or isolate, etc. comprising any Respiratory syncytial virus of any origin.

According to various embodiments, the artificial RNA, preferably the coding sequence of the artificial RNA comprises or consists of a nucleic acid sequence that is derived from viruses, with NCBI Taxonomy ID ("NCBI-ID") provided in List 1 below.

List 1: RSV Virus Strains:

Human orthopneumovirus, HRSV (NCBI-ID 11250); Human respiratory syncytial virus A, HRSV-A, Respiratory syncytial virus group A (NCBI-ID 208893); Human respiratory syncytial virus A strain Long, Human respiratory syncytial virus (subgroup A/strain Long) (NCBI-ID 11260); Human respiratory syncytial virus A2, Human respiratory syncytial virus (strain A2), HRSVA (NCBI-ID 11259); Human respiratory syncytial virus (strain RSB1734), (NCBI-ID 11253); Human respiratory syncytial virus (strain RSB5857) (NCBI-ID 11254); Human respiratory syncytial virus (strain RSB6190), (NCBI-ID 11255); Human respiratory syncytial virus (strain RSB6256), (NCBI-ID 11256); Human respiratory syncytial virus (strain RSB642), (NCBI-ID 11252); Human respiratory syncytial virus (strain RSB6614), (NCBI-ID 11257); Human respiratory syncytial virus B, HRSV-B, Respiratory syncytial virus group B, (NCBI-ID 208895); Human Respiratory syncytial virus 9320 (NCBI-ID 253182); Human respiratory syncytial virus B1 (NCBI-ID 79692); Human respiratory syncytial virus (subgroup B/strain 18537), (NCBI-ID 11251); Human respiratory syncytial virus (subgroup B/strain 8/60), (NCBI-ID 11258); Human respiratory syncytial virus S2, (NCBI-ID 410078); Human respiratory syncytial virus strain RSS-2, (NCBI-ID 11261); unclassified Human respiratory syncytial virus, (NCBI-ID 410233); Human respiratory syncytial virus (strain RSP112/Sweden/02-03), (NCBI-ID 410237); Human respiratory syncytial virus (strain RSP120/Sweden/02-03), (NCBI-ID 410238); Human respiratory syncytial virus (strain RSP121/Sweden/02-03), (NCBI-ID 410239); Human respiratory syncytial virus (strain RSP122/Sweden/02-03), (NCBI-ID 410247); Human respiratory syncytial virus (strain RSP13/Sweden/02-03), (NCBI-ID 410241); Human respiratory syncytial virus (strain RSP140/Sweden/02-03), (NCBI-ID 410248); Human respiratory syncytial virus (strain RSP16/Sweden/02-03), (NCBI-ID 410242); Human respiratory syncytial virus (strain RSP171/Sweden/02-03), (NCBI-ID 410246); Human respiratory syncytial virus (strain RSP183/Sweden/02-03), (NCBI-ID 410249); Human respiratory syncytial virus (strain RSP191/Sweden/02-03), (NCBI-ID 410240); Human respiratory syncytial virus (strain RSP199/Sweden/02-03), (NCBI-ID 410250); Human respiratory syncytial virus (strain RSP212/Sweden/02-03), (NCBI-ID 410251); Human respiratory syncytial virus (strain RSP41/Sweden/02-03), (NCBI-ID 410234); Human respiratory syncytial virus (strain RSP45/Sweden/02-03), (NCBI-ID 410235); Human respiratory syncytial virus (strain RSP56/Sweden/02-03), (NCBI-ID 410243); Human respiratory syncytial virus (strain RSP58/Sweden/02-03), (NCBI-ID 410236); Human respiratory syncytial virus (strain RSP67/Sweden/02-03), (NCBI-ID 410244); Human respiratory syncytial virus (strain RSP94/Sweden/02-03) (NCBI-ID 410245); Respiratory syncytial virus isolate RSV Memphis-37, (strain Memphis-37) (NCBI-ID 12814).

In preferred embodiments of the invention, the at least one antigenic peptide or protein is derived from a Respiratory syncytial virus isolate RSV Memphis-37 (strain Memphis-37) (NCBI-ID: 12814). Throughout the present invention, including the information contained in the ST25 sequence listing, the abbreviation "HRSV(Memphis-37)" is used for said particularly preferred RSV virus.

In preferred embodiments of the invention, the at least one antigenic peptide or protein is derived from a Human respiratory syncytial virus A2, Human respiratory syncytial virus (strain A2) (NCBI-ID: 11259). Throughout the present invention, including the information contained in the ST25 sequence listing, the abbreviation "HRSV(A2)" is used for said particularly preferred RSV virus.

It has to be understood that the skilled person may also use amino acid sequences and nucleic acid sequences derived from any RSV strains provided in List 1 to adapt the teaching of the present invention and to obtain RNA constructs, compositions, and vaccines according to the invention.

In various embodiments, the at least one antigenic peptide or protein may be selected from fusion protein (F), glycoprotein G, short hydrophobic protein SH, matrix protein M, nucleoprotein N, large polymerase L, M2-1 protein, M2-2 protein, phosphoprotein P, non-structural protein NS1, or non-structural protein NS2 of Respiratory syncytial virus (RSV) or a fragment, variant or derivative thereof.

In particularly preferred embodiments of the first aspect, the at least one antigenic peptide or protein is derived from an RSV fusion (F) protein. In this context, the amino acid sequence of the at least one antigenic peptide or protein may be selected from any peptide or protein derived from RSV fusion protein F or from a fragment, variant or derivative thereof.

RSV F protein is initially expressed (after infection of a host cell) as a single polypeptide precursor, designated full-length fusion protein F (herein referred to as "F0"). F0 forms a trimer in the endoplasmic reticulum and is processed by a cellular/host furin-like protease at two conserved sites, generating, F1, F2, and Pep27 polypeptides. The Pep27 polypeptide is excised and does not form part of the mature F protein. The F2 polypeptide originates from the N-terminal portion of the F0 precursor and links to the F1 polypeptide via two disulfide bonds. The F1 polypeptide originates from the C-terminal portion of the F0 precursor and anchors the mature F protein in the membrane via a transmembrane domain, which is linked to a cytoplasmic tail. Three F2-F1 heterodimer units ("protomers") assemble to form a mature F protein. Initially, the mature F protein is in a metastable form (herein referred to as "pre-fusion conformation"). Upon triggering, it undergoes a dramatic and irreversible conformational change (herein referred to as "postfusion conformation") that fuses the viral and target-cell membranes.

Accordingly, the artificial RNA of the first aspect, preferably the artificial RNA suitable for vaccination, encodes at least one antigenic peptide or protein derived from a RSV F protein or a fragment or variant thereof.

In preferred embodiments, at least one antigenic peptide or protein derived from a RSV F protein may be derived from any one of the following amino acid sequences (NCBI Protein Accession numbers) provided in List 2 below.

List 2: NCBI Protein Accession Numbers of RSV Fusion (F) Proteins:

Accession No. Protein, AJF44801.1, AJF44759.1, AJF44661.1, AJF44602.1, 2207424A, AAB38520.1, AAB38517.1, AAB38519.1, AAB38518.1, AVQ93587.1, AVQ93599.1, AVQ93571.1, AVQ93568.1, AVQ93589.1, AVQ93597.1, AVQ93563.1, AVQ93594.1, AVQ93606.1, AVQ93601.1, AVQ93562.1, AVQ93561.1, AVQ93607.1, AVQ93588.1, AVQ93575.1, AVQ93468.1, AVQ93467.1, AVQ93590.1, AVQ93552.1, AVQ93556.1, AVQ93471.1, AVQ93458.1, AVQ93494.1, AVQ93470.1, AVQ93489.1, AVQ93542.1, AVQ93472.1, AVQ93514.1, AVQ93485.1, AVQ93533.1, AVQ93481.1, AVQ93546.1, AVQ93512.1, AVQ93554.1, AVQ93551.1, AVQ93547.1, AVQ93558.1, AVQ93461.1, AVQ93500.1, AVQ93426.1, AVQ93398.1, AVQ93401.1, AVQ93361.1, AVQ93408.1, AVQ93443.1, AVQ93429.1, AVQ93359.1, AVQ93365.1, AVQ93366.1, AVQ93402.1, AVQ93377.1, AVQ93412.1, AVQ93391.1, AVQ93457.1, AVQ93372.1, AVQ93455.1, AVQ93364.1, AVQ93378.1, AVQ93393.1, AVQ93362.1, AVQ93585.1, ART28504.1, AVQ93404.1, AOS49123.1, AOS48496.1, AMT78271.1, AHX57174.1, AHW81390.1, AHV81506.1, AFX60128.1, AFX60129.1, AEQ63389.1, ARB66328.1, ANZ80034.1, AMN91253.1, P03420.1, AIO08046.1, NP_056863.1, AFX60234.1, AFX60231.1, AFX60232.1, AFX60222.1, AFX60219.1, AFX60215.1, AFX60214.1, AFX60212.1, AFX60208.1, AFX60202.1, AFX60220.1, AFX60213.1, AFX60190.1, AFX60187.1, AFX60201.1, AFX60173.1, AFX60169.1, AFX60162.1, AFX60156.1, AFX60151.1, AFX60150.1, AFX60148.1, AFX60141.1, AFX60127.1, AFX60137.1, AFX60135.1, AFV46420.1, AFX60200.1, AFV46419.1, AFV46417.1, AFV46413.1, AFV46414.1, AFV46410.1, AFV46403.1, AFV46409.1, AFP99061.1, AFM95400.1, AFV46401.1, AFP99064.1, AFM95376.1, AFX60138.1, AFP99060.1, AFM95365.1, AFM55563.1, AFM55530.1, AFM55442.1, AFM55420.1, AFM55552.1, AFM55365.1, AFP99059.1, AFM95385.1, AFM55354.1, AFM55343.1, AFM55387.1, AFM55299.1, AFM55288.1, AFM55266.1, AFM55277.1, AFM55255.1, AFM55222.1, AFM55211.1, AFI25262.1, AFD34266.1, AFM55332.1, AFD34264.1, AFD34262.1, AFD34265.1, AFD34261.1, AFD34260.1, AFD34259.1, AEQ63641.1, AEQ63487.1, AEQ63520.1, AEQ63378.1, AEQ63367.1, 4CCF_A, AEQ63334.1, AEO45949.1, AEO45939.1, AEQ63312.1, AEQ63586.1, AEO45919.1, AEO45909.1, AEO45889.1, AEO45879.1, AEO45869.1, AEO45929.1, AEO45850.1, AEO45859.1, AEQ63444.1, AEO23054.1, AEO23052.1, AEO23051.1, AEC32087.1, ADZ95785.1, AEC32085.1, ADZ95784.1, ADZ95783.1, ADZ95782.1, ADZ95781.1, ADZ95779.1, ADZ95780.1, ADZ95777.1, ADZ95778.1, ADZ95776.1, ADZ95775.1, ACY68435.1, ACO83302.1, ABI35685.1, AFI25251.1, AAX23994.1, AAQ97026.1, AAR14266.1, AAQ97027.1, AAQ97030.1, AAQ97028.1, AAC57027.1, AAQ97029.1, AAQ97031.1, AAM68160.1, AAM44851.1, P11209.2, P13843.1, AAO72325.1, AAM68157.1, CAA26143.1, 1512372A, AAB86664.1, AAO72324.1, AAB82446.1, AAO72323.1, AAM68154.1, AAA47410.1, P12568.1, ARB07894.1, AGG39517.1, BBC54612.1, BBC54636.1, BBC54627.1, BBC54621.1, BBC54570.1, BBC54579.1, BBC54595.1, BBC54555.1, BBC54552.1, BBC54564.1, BBC54581.1, BBC54571.1, BBC54553.1, BBC54565.1, BBC54245.1, BBC54243.1, BBC54238.1, BBC54242.1, BBC54239.1, BBC54235.1, BBC54234.1, BBC54236.1, BBC54244.1, BBC54186.1, BBC54178.1, BBC54202.1, BBC54151.1, BBC54142.1, BBC54134.1, BBC54170.1, BBC54210.1, BBC54169.1, BBC54213.1, BBC54203.1, BBC54160.1, BBC54163.1, BBC54215.1, BBC54156.1, BBC54179.1, BBC54150.1, BBC54207.1, BBC54194.1, BBC54149.1, BBC54138.1, BBC54199.1, BBC54220.1, BBC54181.1, BBC54132.1, BBC54146.1, BBC54122.1, BBC54124.1, BBB35202.1, BBB35201.1, BBB35192.1, BBB35193.1, BBB35199.1, BBB35184.1, BBB35126.1, BBB35133.1, BBB35130.1, BBB35160.1, BBB35162.1, BBB35181.1, BBB35165.1, BBB35121.1, BBB35138.1, BBB35176.1, BBB35142.1, BBB35136.1, BBB35153.1, BBB35115.1, BBB35150.1, BBB35097.1, BBB35109.1, BBB35094.1, BBB35183.1, BBB35104.1, BBB35099.1, BBB35188.1, AKA45871.1, ASV65838.1, AGG39373.1, A1122107.1, AGG39400.1, AGG39457.1, ARR29240.1, ARR29251.1, ARR29189.1, ARR29207.1, AUH15164.1, ATV81343.1, AUC68654.1, AUC68577.1, AUC68566.1, AUC68555.1, AUC68478.1, AUC68445.1, AUC68500.1, AUC68522.1, AUC68291.1, AUC68149.1, AUC68094.1, AMA67097.1, AMA66866.1, AMA66580.1, AIZ95750.1, AIZ95541.1, AIZ95519.1, AHY21419.1, AHY21331.1, AHY21165.1, AHY21143.1, AHY21132.1, AGG39478.1, ATV93506.1, ATV93509.1, AIZ95717.1, ATV81354.1, ART28317.1, BBA57890.1, BBA57901.1, ASZ70099.1, ART28361.1, AQX36844.1, ASK05520.1, ART28427.1, ART28339.1, ART28297.1, ART28328.1, ARQ15966.1, ARN61507.1, ARA 5413.1, AGG39394.1, APW78845.1, APW78867.1, APW78900.1, APW78878.1, APW78779.1, APW78702.1, APW78713.1, APW78680.1, APW78658.1, APW78647.1, APW78636.1, AOS48870.1, APW78614.1, AMT78905.1, AMT77402.1, AOZ15479.1, AGN28484.1, AHX57240.1, AHX57031.1, AOS48980.1, AOS48848.1, AOS48815.1, AOS48738.1, AOS49068.1, AOS48727.1, AOS48716.1, AOS48683.1, AOS48551.1, AOS48485.1, AOS48518.1, AOS48441.1, AOS48397.1, AOS48375.1, AOS48353.1, AOS48287.1, AOS48320.1, AOS48265.1, AOS48254.1, AOS48221.1, ANZ79638.1, ALC74025.1, AHV81286.1, AOD40888.1, AOD40516.1, AOD40214.1, AOD40125.1, AOD40104.1, AOD40082.1, AOD39908.1, AJF44826.1, AJF44506.1, AJF44535.1, ANZ80463.1, ANZ80408.1, ANZ80397.1, ANZ80386.1, ANZ80331.1, ANZ80320.1, ANZ80364.1, ANZ80276.1, ANZ80221.1, ANZ80188.1, ANZ80144.1, ANZ80133.1, ANZ80111.1, ANZ80122.1, ANZ80056.1, ANZ80012.1, ANZ80067.1, ANZ79979.1, ANZ79935.1, ANZ79990.1, ANZ79902.1, ANZ79759.1, ANZ79715.1, ANZ79671.1, AMT79718.1, AMT79586.1, AMT79553.1, AMT79542.1, AMT79476.1, AMT79388.1, AMT79201.1, AMT79190.1, AMT79157.1, AMT79124.1, AMT79091.1, AMT79047.1, AMT79014.1, AMT79003.1, AMT78872.1, AMT78832.1, AMT78689.1, AMT78645.1, AMT78513.1, AMT78480.1, AMT78447.1, AMT78392.1, AMT78194.1, AMT78084.1, AMT78051.1, AMT77963.1, AMT77908.1, AMT77776.1, AMT77710.1, AMT77424.1, AMN91385.1, AMN91264.1, AMN91242.1, AHX57504.1, CUS01881.1, CUS01880.1, CUS01877.1, CUS01874.1, CUS01870.1, CUS01875.1, AMA67350.1, AMA67251.1, AMA67262.1, AMA67229.1, AMA67196.1, AMA67130.1, AMA67185.1, AMA67163.1, AMA67086.1, AMA67075.1, AMA66998.1, AMA66987.1, AMA66976.1, AMA66965.1, AMA66921.1, AMA66844.1, AMA66833.1, AMA66624.1, AMA66613.1, AMA66591.1, AMA66569.1, AMA66547.1, AMA66503.1, AMA66492.1, AMA66481.1, AMA66448.1, AMA66415.1, AMA66393.1, AMA66360.1, AGG39553.1, AGG39469.1, AJZ70144.1, AJZ70166.1, AJZ70155.1, AJZ70133.1, AJZ70067.1, AJZ70001.1, AJZ69990.1, AJZ69968.1, AJZ69946.1, AJZ69913.1, AJZ69880.1, AJZ69847.1, AJZ69869.1, AJZ69770.1, AJZ69748.1, AJZ69726.1, AJZ69682.1, AJZ69671.1, AJZ69704.1, AJZ69660.1, AJZ69715.1, AJZ69627.1, AJZ69616.1, AJZ69638.1, AJO16077.1, AJO16055.1, AKE31881.1, AKE31882.1, AKE31878.1, AJF44835.1, AJF44790.1, AJF44737.1, AJF44716.1, AJF44725.1, AJF44643.1, AJF44628.1, AJF44624.1, AJF44613.1, AJF44566.1, AJF44555.1, AJF44526.1, AJF44517.1, AKA45882.1, AKA45849.1, AHA83913.1, AGN28715.1, AHA83902.1, AHA83837.1, AHA83826.1, AHA83705.1, AHA83630.1, AGG39505.1, AIY70242.1, AIY70198.1, A1130203.1, AHY21463.1, AHY21397.1, AHY21320.1, AHY21298.1, AHY21287.1, AHY21276.1, AHY21254.1, AHY21199.1, AHY21176.1, AHX57537.1, AHX57471.1, AHX57427.1, AHX57042.1, AIZ95981.1, AIZ95893.1, AIZ95871.1, AIZ95816.1, AIZ95772.1, AIZ95629.1, AIZ95673.1, AIZ95596.1, AIZ95585.1, AIZ95552.1, AEQ63553.2, AEQ63542.2, AEQ63575.1, AEQ63531.1, AEQ63498.1, AEQ63422.1, AEQ63411.1, AHX57570.1, AHX57152.1, AHX57064.1, AHX57009.1, AHX56987.1, AHV82100.1, AHV82001.1, AHV81891.1, AHV81880.1, AHV81836.1, AHV81682.1, AHV81649.1, AHV81484.1, AHV81462.1, AHV81385.1, AHV81363.1, AHV81330.1, AHV81253.1, AHV81154.1, AHV81122.1, AHV81089.1, AHV81012.1, AHV80957.1, AHV80880.1, AHV80869.1, AHV80836.1, AHV80803.1, AGG39559.1, AGG39562.1, AGG39556.1, AGG39550.1, AGG39547.1, AGG39544.1, AGG39541.1, AGG39529.1, AGG39526.1, AGG39523.1, AGG39514.1, AGG39502.1, AGG39499.1, AGG39496.1, AGG39493.1, AGG39484.1, AGG39490.1, AGG39487.1, AGG39475.1, AGG39472.1, AGG39466.1, AGG39463.1, AGG39454.1, AGG39442.1, AGG39439.1, AGG39436.1, AGG39415.1, AGG39403.1, AGG39397.1, AGG39391.1, AGG39379.1, AHL84194.1, AHA84012.1, AHJ60043.1, BAO49770.1, BAO49766.1, BAO49767.1, AHA84034.1, AHA84023.1, AHA83990.1, AHA83957.1, AHA83924.1, AHA83891.1, AHA83880.1, AHA83782.1, AHA83760.1, AHA83694.1, AGT75357.1, AGN92848.1, AGN28792.1, AGN28781.1, AGN28759.1, AGN28748.1, AGN28693.1, AGN28638.1, AGN28627.1, AGN28539.1, AGN28528.1, AGN28462.1, AGN28440.1, AGL96787.1, AGL96786.1, AGL96784.1, AAS93662.1, AAS93657.1, AAS93656.1, AAS93659.1, AAS93660.1, AAS93663.1, AAS93664.1, AAS93655.1, CUS01869.1, AHG54517.1, ASF87348.1, ASF87341.1, ASF87344.1, ASF87351.1, ASF87338.1, ASF87342.1, ASF87352.1, ASF87337.1, ASF87336.1, AEQ98756.1, AEQ98757.1, AEQ98755.1, AEQ98752.1, AEQ98753.1, AEQ98747.1, ASF87325.1, ASF87326.1, 5W23_A, 5EA3_F, 5UDD_A, 5EA8_F, AHG54458.1, AEN74947.1, AHG54485.1, AHG54477.1, AHG54451.1, AHG54463.1, AHG54445.1, AEO12131.1, AEN74945.1, AEN74944.1, ASF87335.1, AHG54515.1, AHA61605.1, AHV81660.1, AHG54441.1 or AIY60640.1.

In the context of the present invention, "RSV F protein", "RSV fusion protein (F)", "RSV F", or "F" may be understood in its broadest sense and refers to F0 (F polypeptide precursor), F1, F2 and Pep27 polypeptides, F2-F1 heterodimer, or the mature F protein (comprising three F2-F1 heterodimers), or fragments and variants of any of these. Accordingly, the term "peptide or protein derived from a RSV fusion (F) protein" refers to a peptide, protein, fragment or variant derived from e.g. F0 (F protein polypeptide precursor), F1, F2 and Pep27 polypeptides, F2-F1 heterodimer, or the mature F protein. Additionally, the term "peptide or protein derived from a RSV fusion (F) protein" refers to peptide, protein, fragment or variant derived from "RSV F protein" or "RSV fusion protein (F)" as defined above which may be genetically engineered to e.g. to lack certain protein elements (e.g. the cytoplasmic tail, the furin cleavage site, Pep27) or e.g. comprise additional elements (e.g., linker elements, heterologous signal peptides etc.). For example, the term "peptide or protein derived from a RSV fusion (F) protein" refers to peptide, protein, fragment or variant derived from F0, F-del, F0_DSCav1, F_DSCav1_mut1, F_DSCav1_mut2, F_DSCav1_mut3, F_DSCav1_mut4, F_DSCav1_mut5, F_DSCav1_mut6, F_DSCav1_mut7, F_DSCav1_mut8, F_DSCav1_mut0, F-del_DSCav1, F-del_DSCav1_mut1, F-del_DSCav1_mut2, F-del_DSCav1_mut3, F-del_DSCav1_mut4, F-del_DSCav1_mut5, F-del_DSCav1_mut6, F-del_DSCav1_mut7, F-del_DSCav1_mut8, F-del_DSCav1_mut0 (for explanation of the constructs see Table 1). Particularly suitable F protein variants that may be encoded by the RNA of the first aspect are specified in the following and are provided in Table 1.

It has to be noted that where reference is made to amino acid (aa) residues and their position in an RSV F protein, any numbering used herein—unless stated otherwise—relates to the position of the respective aa residue in a corresponding F0 precursor protein of HRSV(A2) (SEQ ID NO: 68) or a corresponding F0 precursor protein of HRSV(Memphis-37) (SEQ ID NO: 8937 or 11726) wherein position "1" corresponds to the first aa residue, i.e. the aa residue at the N-terminus of a HRSV(A2) F0 precursor protein or a HRSV(Memphis-37) F0 precursor protein.

In preferred embodiments, the at least one coding sequence of the RNA of the first aspect encodes at least one antigenic peptide or protein from RSV F protein, wherein RSV F protein is a full-length F protein (F0) or an F protein with deleted C-terminus (F-del), or a fragment or a variant thereof.

In this context, any RSV F full-length protein (precursor protein, referred to as "F0") may be used as suitable antigen and may preferably be derived from any NCBI Protein Accession numbers provided in List 2 or may be chosen from any one of SEQ ID NOs: 68, 8279-8967 or 11726. In preferred embodiments of the invention, the full-length F protein (F0) of HRSV(A2) (SEQ ID NO: 68) is suitably used, see overview Table 1. In other preferred embodiments of the invention, the full-length F protein (F0) of HRSV (Memphis-37) (SEQ ID NO: 8937 or 11726) is suitably used, see overview Table 1.

In this context, any RSV F with deleted C-terminus (F-del) may be used as suitable antigen and may preferably be derived from any NCBI Protein Accession numbers provided in List 2 or may be chosen from any one of SEQ ID NOs: 483, 8968-9683, or 12095. An example of such a deletion mutant is the RSV-Fdel554-574 protein according to (Oomens et al. 2006. J. Virol. 80(21):10465-77) where aa residue 554-574 of the full-length F0 protein are removed. Deletion of the main part of the cytoplasmic tail (aa 554-574) of F0 leads to improved intracellular trafficking/cell surface transport in vitro and increases cell surface expression of RSV F significantly. Increased cell surface presentation results in improved B cell recognition (in line with published data; see WO2015024668). In preferred embodiments of the invention, F protein with deleted C-terminus, herein referred to as "F-del" (SEQ ID NO: 483, 9653 or 12095) is suitably used, see overview Table 1. In the light of high level of structural conservation of the RSV F protein among different RSV strains (see e.g. Hause et al., 2017, PLOS ONE 12(6): e0180623), the deletion of aa 554-574 is applicable to different RSV F protein sequences of different RSV isolates.

In particularly preferred embodiments, the artificial RNA of the first aspect encodes least one antigenic peptide or protein derived from RSV F protein, wherein said RSV F protein is designed to stabilize the antigen in pre-fusion conformation. A pre-fusion conformation is particularly advantageous in the context of an efficient RSV vaccine, as several potential epitopes for neutralizing antibodies are merely accessible in said protein conformation.

In several embodiments, the RSV F protein includes one or more amino acid substitutions that stabilize the F protein in the pre-fusion conformation, for example, substitutions that stabilize the membrane distal portion of the F protein (including the N-terminal region of the F1 polypeptide) in the pre-fusion conformation. For example, the amino acid substitution can introduce a non-natural disulfide bond or can be a cavity-filling amino acid substitution.

Accordingly, in several embodiments, a preferred RSV F protein includes S155C and S290C substitutions that form a non-natural disulfide bond that stabilizes the protein in a pre-fusion conformation; that is, in a conformation that specifically binds to one or more pre-fusion specification antibodies, and/or presents a suitable antigenic site that is present on the pre-fusion conformation but not in the post-fusion conformation of RSV F protein. In further embodiments, the recombinant RSV F protein can additionally include F, L, W, Y, H, or M substitution at position 190, position 207, or positions 190 and 207.

An example of an RSV F protein designed to stabilize the antigen in pre-fusion conformation is RSV F protein comprising a DSCav1 mutation (S155C, S290C, S190F, and V207L), or a fragment or a variant thereof. Such RSV F DSCav1 proteins have been described in the art (WO2014160463).

Accordingly, in particularly preferred embodiments, the artificial RNA of the first aspect encodes least one antigenic peptide or protein derived from RSV F protein, wherein the RSV F protein comprises a DSCav1 mutation (S155C, S290C, S190F, and V207L), or a fragment or a variant thereof.

It has to be understood in the context of the invention that any RSV F may be mutated at positions S155C, S290C, S190F, and V207L to stabilize the protein in the pre-fusion conformation and may be suitably used in the context of the invention. Accordingly, any NCBI Protein Accession numbers provided above, or any protein selected from SEQ ID NOs: 68, 8279-8967, 483, 8968-9683, 12095, or 11726 or fragments or variants thereof can be chosen by the skilled person to introduce such amino acid changes according to S155C, S290C, S190F, and V207L to generate various RSV F DSCav1 proteins.

In preferred embodiments, RSV F full-length protein (precursor protein, "F0") of HRSV(A2) (SEQ ID NO: 68) is used to introduce S155C, S290C, S190F, and V207L amino acid changes, leading to an amino acid sequence according to SEQ ID NO: 898. Such a RSV F protein is herein referred to as "F0_DSCav1" throughout the present invention (see overview Table 1 (preferred RSV F protein antigen designs)).

In other preferred embodiments, RSV F_del protein (deleted cytoplasmic tail (aa 554-574)) of HRSV(A2) (SEQ ID NO: 483) is used to introduce S155C, S290C, S190F, and V207L amino acid changes, leading to an amino acid sequence according to SEQ ID NO: 1267. Such a RSV F protein is herein referred to as "F-del_DSCav1" throughout the present invention (see overview Table 1 (preferred RSV F protein antigen designs)).

In preferred embodiments, RSV F full-length protein (precursor protein, "F0") of HRSV(Memphis-37) (SEQ ID NO: 8937 or 11726) is used to introduce S155C, S290C, S190F, and V207L amino acid changes, leading to an amino acid sequence according to SEQ ID NO: 12464. Such a RSV F protein is herein referred to as "F0_DSCav1" throughout the present invention (see overview Table 1 (preferred RSV F protein antigen designs)).

In other preferred embodiments, RSV F_del protein (deleted cytoplasmic tail (aa 554-574)) of HRSV(Memphis-37) (SEQ ID NO: 9653 or 12095) is used to introduce S155C, S290C, S190F, and V207L amino acid changes, leading to an amino acid sequence according to SEQ ID NO: 12833. Such a RSV F protein is herein referred to as "F-del_DSCav1" throughout the present invention (see overview Table 1 (preferred RSV F protein antigen designs).

In preferred embodiments, the at least one antigenic peptide or protein may be an engineered protein comprising the two subunits, F1 and F2 of mature F as a single polypeptide chain, wherein F2 and F1 are preferably connected via a linker (GS). Examples of said engineered F2-linker-F1 fusion proteins (e.g., F(1-103)-GS-F(145-574) or F(1-103)-GS-F(145-553)) have been described in the art (Joyce, M. Gordon, et al. "Iterative structure-based improvement of a fusion-glycoprotein vaccine against RSV." Nature structural & molecular biology 23.9 (2016): 811;

WO2017172890). Said F2-linker-F1 RSV F proteins lack aa104-144 (comprising the furine cleavage site and Pep27) and comprise a linker element between F2 polypeptide and F1 polypeptide (e.g. GS linker). Said F2-linker-F1 proteins may show superior properties in terms of stability and/or antigenicity.

Accordingly, in preferred embodiments, the RSV F protein comprises the two subunits F2 and F1 fused into a single polypeptide chain, wherein F2 and F1 are connected via a linker element, preferably a GS linker as specified herein, preferably generating a stable F2-linker-F1 proteins.

Preferably, said F2-linker-F1 fusion proteins, e.g. F(1-103)-GS-F(145-574) or F(1-103)-GS-F(145-553) additionally comprise a DScav1 mutation as outlined above (herein referred to as "mut0"; e.g., SEQ ID NOs: 3850, 4219 or 13940, 14309).

In particularly preferred embodiments, the RSV F protein may additionally comprise at least one further mutation selected from (S46G, A149C, S215P, Y458C, K465Q), (S46G, E92D, A149C, S215P, Y458C, K465Q), (S46G, N67I, E92D, A149C, S215P, Y458C, K465Q), (A149C, Y458C), (N183GC, N428C), (Q98C, Q361C, S46G, E92D, L95M, S215P, I217P, I221M, R429K, K465Q), (Q98C, Q361C, L95M, I221M, R429K), or (N183GC, N428C, S46G, N67I, E92D, S215P, K465Q) or a fragment or a variant thereof.

In particularly preferred embodiments, said F2-linker-F1 proteins (F(1-103)-GS-F(145-574) or F(1-103)-GS-F(145-553)) may additionally comprise, preferably in addition to the DSCav1 mutation, at least one mutation selected from S46G, A149C, S215P, Y458C, K465Q, herein referred to as "mut1", e.g., SEQ ID NOs: 1636, 2005, or 14678, 15047; or S46G, E92D, A149C, S215P, Y458C, K465Q, herein referred to as "mut2", e.g., SEQ ID NOs: 2374, 2743 or 15416, 15785; or S46G, N67I, E92D, A149C, S215P, Y458C, K465Q, herein referred to as "mut3", e.g., SEQ ID NOs: 3112, 3481 or 13202, 13571, or a fragment or a variant of any of these (see overview Table 1 (preferred RSV F protein antigen designs)).

In other embodiments, said F2-linker-F1 proteins (F(1-103)-GS-F(145-574) or F(1-103)-GS-F(145-553)) may additionally comprise, preferably in addition to the DSCav1 mutation, at least one mutation selected from A149C, Y458C, herein referred to as "mut4", e.g., SEQ ID NOs: 4588, 4957 or 16154, 16523; or N183GC, N428C, herein referred to as "mut5", e.g., SEQ ID NOs: 5326, 5695 or 16892, 17261; or Q98C, Q361C, S46G, E92D, L95M, S215P, I217P, I221M, R429K, K465Q, herein referred to as "mut6", e.g., SEQ ID NOs: 6064, 6433 or 17630, 17999; or Q98C, Q361C, L95M, I221M, R429K, herein referred to as "mut8", e.g., SEQ ID NOs: 6802, 7171 or 18368, 18737; or N183GC, N428C, S46G, N67I, E92D, S215P, K465Q, herein referred to as "mut8", e.g., SEQ ID NOs: 7540, 7909 or 19106, 19475, or a fragment or a variant thereof.

It has to be understood in the context of the invention that any RSV F may be adapted in a way that the two subunits, F1 and F2 are comprised in a single polypeptide chain, wherein F2 and F1 may be connected via a linker, e.g. a (GS) linker to enhance stability of the protein as explained for mutations "mut1", "mut2" and "mut3", e.g. by deleting aa104-144 of the F0 polypeptide chain (as explained above), by introducing a linker element between F2 and F1 as explained above, and by introducing suitable amino acid substitutions as explained above. Accordingly, any NCBI Protein Accession numbers provided above (see List 2), or any protein selected from SEQ ID NOs: 68, 8279-8967, 483, 8968-9683, 11726, 12095 or fragments or variants thereof can be adapted by the skilled person to generate F2-linker-F1 fusion proteins as outlined herein, and may additionally be adapted by introducing (S46G, A149C, S215P, Y458C, K465Q), (S46G, E92D, A149C, S215P, Y458C, K465Q), (S46G, N67I, E92D, A149C, S215P, Y458C, K465Q), (A149C, Y458C), (N183GC, N428C), (Q98C, Q361C, S46G, E92D, L95M, S215P, I217P, I221M, R429K, K465Q), (Q98C, Q361C, L95M, I221M, R429K), or (N183GC, N428C, S46G, N67I, E92D, S215P, K465Q) aa substitutions and/or a DSCav1 mutation. Moreover, apart from using a GS linker as outlined above, the skilled person may of course choose between various known linker elements to arrive at similar likewise suitable RSV F protein variants (e.g. selected from SEQ ID NOs: 117-162 of the patent application WO2017/172890 or fragments or variants of these sequences, or selected from SEQ ID NOs: 1509-1565 of the patent application WO2017/081082, or fragments or variants of these sequences).

In preferred embodiments, F2-linker-F1 proteins (F(1-103)-GS-F(145-574) or F(1-103)-GS-F(145-553) comprise a DSCav-1 mutation as outlined above, herein referred to as F_DSCav1_mut0 or F-del_DSCav1_mut0. In preferred embodiments, F2-linker-F1 proteins (F(1-103)-GS-F(145-574) or F(1-103)-GS-F(145-553) comprise a DSCav-1 mutation as outlined above, and additionally an amino acid substitution mut1 as defined above, herein referred to as F_DSCav1_mut1 or F-del_DSCav1_mut1. In preferred embodiments, F2-linker-F1 proteins (F(1-103)-GS-F(145-574) or F(1-103)-GS-F(145-553) comprise a DSCav-1 mutation as outlined above, and additionally an amino acid substitution mut2 as defined above, herein referred to as F_DSCav1_mut2 or F-del_DSCav1_mut2. In preferred embodiments, F2-linker-F1 proteins (F(1-103)-GS-F(145-574) or F(1-103)-GS-F(145-553) comprise a DSCav-1 mutation as outlined above, and additionally an amino acid substitution mut3 as defined above, herein referred to as F_DSCav1_mut3 or F-del_DSCav1_mut3. In preferred embodiments, F2-linker-F1 proteins (F(1-103)-GS-F(145-574) or F(1-103)-GS-F(145-553) comprise a DSCav-1 mutation as outlined above, and additionally an amino acid substitution mut4 as defined above, herein referred to as F_DSCav1_mut4 or F-del_DSCav1_mut4. In preferred embodiments, F2-linker-F1 proteins (F(1-103)-GS-F(145-574) or F(1-103)-GS-F(145-553) comprise a DSCav-1 mutation as outlined above, and additionally an amino acid substitution mut5 as defined above, herein referred to as F_DSCav1_mut5 or F-del_DSCav1_mut5. In preferred embodiments, F2-linker-F1 proteins (F(1-103)-GS-F(145-574) or F(1-103)-GS-F(145-553) comprise a DSCav-1 mutation as outlined above, and additionally an amino acid substitution mut6 as defined above, herein referred to as F_DSCav1_mut6 or F-del_DSCav1_mut6 (. In preferred embodiments, F2-linker-F1 proteins (F(1-103)-GS-F(145-574) or F(1-103)-GS-F(145-553) comprise a DSCav-1 mutation as outlined above, and additionally an amino acid substitution mut7 as defined above, herein referred to as F_DSCav1_mut7 or F-del_DSCav1_mut7. In preferred embodiments, F2-linker-F1 proteins (F(1-103)-GS-F(145-574) or F(1-103)-GS-F(145-553) comprise a DSCav-1 mutation as outlined above, and additionally an amino acid substitution mut8 as defined above, herein referred to as F_DSCav1_mut8 or F-del_DSCav1_mut8.

A detailed description of particularly preferred RSV F proteins is provided in Table 1.

In Table 1 all references made to amino acid (aa) residues and their position in an RSV F protein relates to the position of the respective aa residue in a corresponding F0 precursor protein of HRSV(A2) (SEQ ID NO: 68) or HRSV(Memphis-37) (SEQ ID NO: 8937 or 11726). Moreover, the abbreviations for suitable RSV F protein antigen designs in Table 1 are used throughout the description of the invention (e.g., "F0", "F-del", "F0_DSCav1", "F-del_DSCav1", "F_DSCav1_mut1", "F-del_DSCav1_mut1", "F_DSCav1_mut2", "F-del_DSCav1_mut2", "F_DSCav1_mut3", "F-del_DSCav1_mut3", "F_DSCav1_mut4", "F-del_DSCav1_mut4", "F_DSCav1_mut5", "F-del_DSCav1_mut5", "F_DSCav1_mut6", "F-del_DSCav1_mut6", "F_DSCav1_mut7", "F-del_DSCav1_mut7", "F_DSCav1_mut8", "F-del_DSCav1_mut8", "F_DSCav1_mut0", "F-del_DSCav1_mut0"). Column A of Table 1 provides protein SEQ ID NOs of respective RSV F protein antigen designs derived from HRSV(A2); Column B of Table 1 provides protein SEQ ID NOs of respective RSV F protein antigen designs derived from HRSV(Memphis-37). Notably, the description of the invention explicitly includes the information provided under <223> identifier of the ST25 sequence listing of the present application.

TABLE 1

Preferred RSV F protein antigen designs

| Antigen Name | Protein design description | A | B |
|---|---|---|---|
| F0 | aa1-574, full-length RSV F0 precursor | 68 | 8937, 11726 |
| F-del | aa1-553, deletion of aa 554-574 of the C-terminus | 483 | 9653, 12095 |
| F0_DSCav1 | aa1-574, aa substitutions: S155C, S290C, S190F, and V207L | 898 | 12464 |
| F-del_DSCav1 | aa1-553, deletion of aa 554-574 of the C-terminus, aa substitutions: S155C, S290C, S190F, and V207L | 1267 | 12833 |
| F_DSCav1_mut0 | aa1-103 - GS(linker) - aa145-574 F2-linker-F1 construct aa substitutions: S155C, S290C, S190F, and V207L | 3850 | 13940 |
| F-del_DSCav1_mut0 | aa1-103 - GS(linker) - aa145-553 deletion of aa 554-574 of the C-terminus, F2-linker-F1 construct aa substitutions: S155C, S290C, S190F, and V207L | 4219 | 14309 |
| F_DSCav1_mut1 | aa1-103 - GS(linker) - aa145-574, F2-linker-F1 construct, aa substitutions: S155C, S290C, S190F, and V207L; S46G, A149C, S215P, Y458C, K465Q | 1636 | 14678 |
| F-del_DSCav1_mut1 | aa1-103 - GS(linker) - aa145-553 deletion of aa 554-574 of the C-terminus, F2-linker-F1 construct, aa substitutions: S155C, S290C, S190F, and V207L; S46G, A149C, S215P, Y458C, K465Q | 2005 | 15047 |
| F_DSCav1_mut2 | aa1-103 - GS(linker) - aa145-574 F2-linker-F1 construct, aa substitutions: S155C, S290C, S190F, and V207L; S46G, E92D, A149C, S215P, Y458C, K465Q | 2374 | 15416 |
| F-del_DSCav1_mut2 | aa1-103 - GS(linker) - aa145-553 deletion of aa 554-574 of the C-terminus, F2-linker-F1 construct, aa substitutions: S155C, S290C, S190F, and V207L; S46G, E92D, A149C, S215P, Y458C, K465Q | 2743 | 15785 |
| F_DSCav1_mut3 | aa1-103 - GS(linker) - aa145-574 F2-linker-F1 construct, aa substitutions: S155C, S290C, S190F, and V207L; S46G, N67I, E92D, A149C, S215P, Y458C, K465Q | 3112 | 13202 |
| F-del_DSCav1_mut3 | aa1-103 - GS(linker) - aa145-553 deletion of aa 554-574 of the C-terminus, F2-linker-F1 construct, aa substitutions: S155C, S290C, S190F, and V207L; S46G, N67I, E92D, A149C, S215P, Y458C, K465Q | 3481 | 13571 |
| F_DSCav1_mut4 | aa1-103 - GS(linker) - aa145-574 F2-linker-F1 construct, aa substitutions: S155C, S290C, S190F, and V207L; A149C, Y458C | 4588 | 16154 |
| F-del_DSCav1_mut4 | aa1-103 - GS(linker) - aa145-553 deletion of aa 554-574 of the C-terminus, F2-linker-F1 construct, aa substitutions: S155C, S290C, S190F, and V207L; A149C, Y458C | 4957 | 16523 |
| F_DSCav1_mut5 | aa1-103 - GS(linker) - aa145-574 F2-linker-F1 construct, aa substitutions: S155C, S290C, S190F, and V207L; N183GC, N428C | 5326 | 16892 |
| F-del_DSCav1_mut5 | aa1-103 - GS(linker) - aa145-553 deletion of aa 554-574 of the C-terminus, F2-linker-F1 construct, aa substitutions: S155C, S290C, S190F, and V207L; N183GC, N428C | 5695 | 17261 |

TABLE 1-continued

Preferred RSV F protein antigen designs

| Antigen Name | Protein design description | A | B |
|---|---|---|---|
| F_DSCav1_mut6 | aa1-103 - GS(linker) - aa145-574<br>F2-linker-F1 construct,<br>aa substitutions: S155C, S290C, S190F, and V207L;<br>Q98C, Q361C, S46G, E92D, L95M, S215P, I217P, I221M, R429K, K465Q | 6064 | 17630 |
| F-del_DSCav1_mut6 | aa1-103 - GS(linker) - aa145-553<br>deletion of aa 554-574 of the C-terminus,<br>F2-linker-F1 construct,<br>aa substitutions: S155C, S290C, S190F, and V207L;<br>Q98C, Q361C, S46G, E92D, L95M, S215P, I217P, I221M, R429K, K465Q | 6433 | 17999 |
| F_DSCav1_mut7 | aa1-103 - GS(linker) - aa145-574<br>F2-linker-F1 construct,<br>aa substitutions: S155C, S290C, S190F, and V207L;<br>Q98C, Q361C, L95M, I221M, R429K | 6802 | 18368 |
| F-del_DSCav1_mut7 | aa1-103 - GS(linker) - aa145-553<br>deletion of aa 554-574 of the C-terminus,<br>F2-linker-F1 construct,<br>aa substitutions: S155C, S290C, S190F, and V207L;<br>Q98C, Q361C, L95M, I221M, R429K | 7171 | 18737 |
| F_DSCav1_mut8 | aa1-103 - GS(linker) - aa145-574<br>F2-linker-F1 construct,<br>aa substitutions: S155C, S290C, S190F, and V207L;<br>N183GC, N428C, S46G, N67I, E92D, S215P, K465Q | 7540 | 19106 |
| F-del_DSCav1_mut8 | aa1-103 - GS(linker) - aa145-553<br>deletion of aa 554-574 of the C-terminus,<br>F2-linker-F1 construct,<br>aa substitutions: S155C, S290C, S190F, and V207L;<br>N183GC, N428C, S46G, N67I, E92D, S215P, K465Q | 7909 | 19475 |

In particularly preferred embodiments, the artificial RNA according to the first aspect encodes at least one antigenic peptide or protein derived from a RSV fusion (F) protein, wherein the RSV F protein is selected from F0, F-del, F0_DSCav1, F_DSCav1_mut0, F_DSCav1_mut1, F_DSCav1_mut2, F_DSCav1_mut3, F_DSCav1_mut4, F_DSCav1_mut5, F_DSCav1_mut6, F_DSCav1_mut7, F_DSCav1_mut8, F-del_DSCav1, F-del_DSCav1 mut0, F-del_DSCav1 mut1, F-del_DSCav1 mut2, F-del_DSCav1_mut3, F-del_DSCav1 mut4, F-del_DSCav1_mut5, F-del_DSCav1_mut6, F-del_DSCav1_mut7, F-del_DSCav1_mut8, or a fragment or a variant thereof (see e.g. Table 1).

Particularly preferred and advantageous in the context of the invention are RSV F proteins selected from F-del_D-SCav1, F-del_DSCav1 mut0, F-del_DSCav1 mut1, F-del_DSCav1 mut2, F-del_DSCav1 mut3, F-del_DSCav1_mut4, F-del_DSCav1_mut5, F-del_DSCav1_mut6, F-del_DSCav1_mut7, F-del_DSCav1_mut8 or a fragment or a variant thereof (see e.g. Table 1).

In preferred embodiments, the artificial RNA of the first aspect comprises at least one coding sequence encoding at least one antigenic peptide or protein comprising or consisting of at least one amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 68, 483, 898, 1267, 1636, 2005, 2374, 2743, 3112, 3481, 3850, 4219, 4588, 4957, 5326, 5695, 6064, 6433, 6802, 7171, 7540, 7909, 11726, 12095, 12464, 12833, 13940, 14309, 14678, 15047, 15416, 15785, 13202, 13571, 16154, 16523, 16892, 17261, 17630, 17999, 18368, 18737, 19106, 19475 (see e.g. Table 1), or 8279-9683 or a fragment or variant of any of these sequences. Additional information regarding each of these suitable amino acid sequences encoding RSV proteins may also be derived from the sequence listing, in particular from the details provided therein under identifier <223> as explained in the following.

In preferred embodiments, the artificial RNA of the first aspect comprises at least one coding sequence encoding at least one antigenic peptide or protein comprising or consisting of at least one amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 68, 483, 898, 1267, 1636, 2005, 2374, 2743, 3112, 3481, 3850, 4219, 4588, 4957, 5326, 5695, 6064, 6433, 6802, 7171, 7540, 7909, 11726, 12095, 12464, 12833, 13940, 14309, 14678, 15047, 15416, 15785, 13202, 13571, 16154, 16523, 16892, 17261, 17630, 17999, 18368, 18737, 19106, 19475 (see e.g. Table 1) or a fragment or variant of any of these sequences. Additional information regarding each of these suitable amino acid sequences encoding RSV proteins may also be derived from the sequence listing, in particular from the details provided therein under identifier <223> as explained in the following.

In particularly preferred embodiments, the artificial RNA of the first aspect comprises at least one coding sequence encoding at least one antigenic peptide or protein comprising or consisting of at least one amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 1267, 2005, 2743, 3481, 4219, 4957, 5695, 6433, 7171, 7909, 12833, 14309, 15047, 15785, 13571, 16523, 17261, 17999, 18737, 19475 (see e.g. Table 1) or a fragment or variant of any of these sequences. Additional information regarding each of these suitable amino acid sequences encoding RSV proteins may also be derived from the sequence listing, in particular from the details provided therein under identifier <223> as explained in the following.

In other embodiments, the artificial RNA according to the first aspect comprises at least one coding sequence encoding at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 8279-9683 a fragment or variant of any of these sequences. Additional information regarding each of these suitable amino acid sequences encoding RSV proteins may also be derived from the sequence listing, in particular from the details provided therein under identifier <223> as explained in the following.

In other embodiments, the artificial RNA as defined herein comprises at least one coding sequence encoding at least one antigenic peptide or protein derived from RSV comprising or consisting of at least one amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1-1428 of patent application WO2014/160463 or a fragment or variant of any of these sequences. In this context, SEQ ID NOs: 1-1428 of patent application WO2014/160463 and the disclosure related thereto are herewith incorporated by reference.

In other embodiments, the artificial RNA as defined herein comprises at least one coding sequence encoding at least one antigenic peptide or protein derived from RSV comprising or consisting of at least one amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1-11 of patent application WO2015/024668 or a fragment or variant of any of these sequences. In this context, SEQ ID NOs: 1-11 of patent application WO2015/024668 and the disclosure related thereto are herewith incorporated by reference.

In other embodiments, the artificial RNA as defined herein comprises at least one coding sequence encoding at least one antigenic peptide or protein derived from RSV comprising or consisting of at least one amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 3, 4, 6, 8, 10, 12, 14, 16, 18, 20, 22, 24, 26, 28, 243, or 245 of patent application WO2017/070622 or a fragment or variant of any of these sequences. In this context SEQ ID NO: 3, 4, 6, 8, 10, 12, 14, 16, 18, 20, 22, 24, 26, 28, 243, or 245, of patent application WO2017/070622 and the disclosure related thereto are herewith incorporated by reference.

In other embodiments, the artificial RNA as defined herein comprises at least one coding sequence encoding at least one antigenic peptide or protein derived from RSV comprising or consisting of at least one amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1-65, 81-95, 110-116 of patent application WO2017/172890 or a fragment or variant of any of these sequences. In this context SEQ ID NOs: 1-65, 81-95, 110-116, of patent application WO2017/172890 and the disclosure related thereto are herewith incorporated by reference.

According to another preferred embodiment, the artificial RNA of the invention encodes at least one antigenic peptide or protein as defined above and may additionally encode at least one further heterologous peptide or protein element.

Suitably, the at least one further peptide or protein element may promote secretion of the encoded antigenic peptide or protein of the invention (e.g. via secretory signal sequences), promote anchoring of the encoded antigenic peptide or protein of the invention in the plasma membrane (e.g. via transmembrane elements), promote formation of antigen complexes (e.g. via multimerization domains), promote virus-like particle formation (VLP forming sequence). In addition, the artificial nucleic acid sequence according to the present invention may additionally encode peptide linker elements, self-cleaving peptides, immunologic adjuvant sequences or dendritic cell targeting sequences. Suitable multimerization domains may be selected from the list of amino acid sequences according to SEQ ID NOs: 1116-1167 of the patent application WO2017/081082, or fragments or variants of these sequences. Trimerization and tetramerization elements may be selected from e.g. engineered leucine zippers (engineered α-helical coiled coil peptide that adopt a parallel trimeric state), fibritin foldon domain from enterobacteria phage T4, GCN4pII, GCN4-pLI, and p53. In that context, fibritin foldon domain from enterobacteria phage T4, GCN4pII, GCN4-pLI, and p53 are preferred. Suitable transmembrane elements may be selected from the list of amino acid sequences according to SEQ ID NOs: 1228-1343 of the patent application WO2017/081082, or fragments or variants of these sequences. Suitable VLP forming sequences may be selected from the list of amino acid sequences according to SEQ ID NOs: 1168-1227 of the patent application WO2017/081082, or fragments or variants of these sequences. Suitable peptide linkers may be selected from the list of amino acid sequences according to SEQ ID NOs: 1509-1565 of the patent application WO2017/081082, or fragments or variants of these sequences. Suitable self-cleaving peptides may be selected from the list of amino acid sequences according to SEQ ID NOs: 1434-1508 of the patent application WO2017/081082, or fragments or variants of these sequences. Suitable immunologic adjuvant sequences may be selected from the list of amino acid sequences according to SEQ ID NOs: 1360-1421 of the patent application WO2017/081082, or fragments or variants of these sequences. Suitable dendritic cell (DCs) targeting sequences may be selected from the list of amino acid sequences according to SEQ ID NOs: 1344-1359 of the patent application WO2017/081082, or fragments or variants of these sequences. Suitable secretory signal peptides may be selected from the list of amino acid sequences according to SEQ ID NOs: 1-1115 and SEQ ID NO: 1728 of the patent application WO2017/081082, or fragments or variants of these sequences. On nucleic acid level, any nucleic acid sequence (e.g. RNA sequence) may be selected which encodes such amino acid sequences. In this context, the disclosure of WO2017/081082 is herewith incorporated by reference. The heterologous secretory signal sequence may increase the secretion of the encoded antigenic peptide or protein.

According to embodiments, the secretory signal sequence comprises an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 21329-21362 or a fragment or variant of any of these sequences. Additional information regarding each of these suitable amino acid sequences encoding secretory signal sequences may also be derived from the sequence listing, in particular from the details provided therein under identifier <223>.

According to preferred embodiments, the artificial nucleic acid, particularly the artificial RNA comprises at least one coding sequence encoding at least one antigenic peptide or protein derived from RSV as defined herein, preferably derived from RSV F protein, or fragments and variants thereof. In that context, any coding sequence encoding at least one antigenic peptide or protein derived from RSV, preferably derived from RSV F protein, or fragments and variants thereof may be understood as suitable coding sequence and may therefore be comprised in the artificial RNA of the first aspect.

In preferred embodiments, the artificial RNA of the first aspect may comprise or consist of at least one coding sequence encoding at least one antigenic peptide or protein derived from RSV F protein as defined herein, preferably encoding any one of SEQ ID NO: 68, 483, 898, 1267, 1636, 2005, 2374, 2743, 3112, 3481, 3850, 4219, 4588, 4957, 5326, 5695, 6064, 6433, 6802, 7171, 7540, 7909, 11726, 12095, 12464, 12833, 13940, 14309, 14678, 15047, 15416, 15785, 13202, 13571, 16154, 16523, 16892, 17261, 17630, 17999, 18368, 18737, 19106, 19475 or fragments of variants thereof. It has to be understood that, on nucleic acid level, any nucleic acid sequence, in particular, any RNA sequence which encodes an amino acid sequences being identical to SEQ ID NO: 68, 483, 898, 1267, 1636, 2005, 2374, 2743, 3112, 3481, 3850, 4219, 4588, 4957, 5326, 5695, 6064, 6433, 6802, 7171, 7540, 7909, 11726, 12095, 12464, 12833, 13940, 14309, 14678, 15047, 15416, 15785, 13202, 13571, 16154, 16523, 16892, 17261, 17630, 17999, 18368, 18737, 19106, 19475 or fragments or variants thereof, or any nucleic acid sequence (e.g. DNA sequence, RNA sequence) which encodes amino acid sequences being at least 70%, 80%, 85%, 86%, 87%, 88%, 89%, 90%, 91%, 92%, 93%, 94%, 95%, 96%, 97%, 98%, or 99% identical to any one of SEQ ID NO: 68, 483, 898, 1267, 1636, 2005, 2374, 2743, 3112, 3481, 3850, 4219, 4588, 4957, 5326, 5695, 6064, 6433, 6802, 7171, 7540, 7909, 11726, 12095, 12464, 12833, 13940, 14309, 14678, 15047, 15416, 15785, 13202, 13571, 16154, 16523, 16892, 17261, 17630, 17999, 18368, 18737, 19106, 19475 or fragments or variants thereof, may be selected and may accordingly be understood as suitable coding sequence and may therefore be comprised in the artificial RNA of the first aspect of the invention.

In other embodiments, the artificial RNA of the first aspect may comprise or consist of at least one coding sequence encoding any one of SEQ ID NOs: 8279-9683 or fragments of variants thereof. It has to be understood that, on nucleic acid level, any nucleic acid sequence, in particular, any RNA sequence which encodes an amino acid sequences being identical to SEQ ID NOs: 8279-9683 or fragments or variants thereof, or any nucleic acid sequence (e.g. DNA sequence, RNA sequence) which encodes amino acid sequences being at least 70%, 80%, 85%, 86%, 87%, 88%, 89%, 90%, 91%, 92%, 93%, 94%, 95%, 96%, 97%, 98%, or 99% identical to any one of SEQ ID NOs: 8279-9683 or fragments or variants thereof, may be selected and may accordingly be understood as suitable coding sequence and may therefore be comprised in the artificial RNA of the first aspect of the invention.

In other embodiments, the artificial RNA of the first aspect may comprise or consist of at least one coding sequence encoding any one of SEQ ID NOs: 1-1428 of patent application WO2014/160463 or fragments of variants thereof. It has to be understood that, on nucleic acid level, any nucleic acid sequence, in particular, any RNA sequence which encodes an amino acid sequences being identical to SEQ ID NOs: 1-1428 of patent application WO2014/160463 or fragments or variants thereof, or any nucleic acid sequence (e.g. DNA sequence, RNA sequence) which encodes amino acid sequences being at least 70%, 80%, 85%, 86%, 87%, 88%, 89%, 90%, 91%, 92%, 93%, 94%, 95%, 96%, 97%, 98%, or 99% identical to any one of SEQ ID NOs: 1-1428 of patent application WO2014/160463 or fragments or variants thereof, may be selected and may accordingly be understood as suitable coding sequence and may therefore be comprised in the artificial RNA of the first aspect of the invention.

In other embodiments, the artificial RNA of the first aspect may comprise or consist of at least one coding sequence encoding any one of SEQ ID NOs: 1-11 of patent application WO2015/024668 or fragments of variants thereof. It has to be understood that, on nucleic acid level, any nucleic acid sequence, in particular, any RNA sequence which encodes an amino acid sequences being identical to SEQ ID NOs: 1-11 of patent application WO2015/024668 or fragments or variants thereof, or any nucleic acid sequence (e.g. DNA sequence, RNA sequence) which encodes amino acid sequences being at least 70%, 80%, 85%, 86%, 87%, 88%, 89%, 90%, 91%, 92%, 93%, 94%, 95%, 96%, 97%, 98%, or 99% identical to any one of SEQ ID NOs: 1-11 of patent application WO2015/024668 or fragments or variants thereof, may be selected and may accordingly be understood as suitable coding sequence and may therefore be comprised in the artificial RNA of the first aspect of the invention.

In other embodiments, the artificial RNA of the first aspect may comprise or consist of at least one coding sequence encoding any one of SEQ ID NO: 3, 4, 6, 8, 10, 12, 14, 16, 18, 20, 22, 24, 26, 28, 243, or 245 of patent application WO2017/070622 or fragments of variants thereof. It has to be understood that, on nucleic acid level, any nucleic acid sequence, in particular, any RNA sequence which encodes an amino acid sequences being identical to SEQ ID NO: 3, 4, 6, 8, 10, 12, 14, 16, 18, 20, 22, 24, 26, 28, 243, or 245 of patent application WO2017/070622 or fragments or variants thereof, or any nucleic acid sequence (e.g. DNA sequence, RNA sequence) which encodes amino acid sequences being at least 70%, 80%, 85%, 86%, 87%, 88%, 89%, 90%, 91%, 92%, 93%, 94%, 95%, 96%, 97%, 98%, or 99% identical to any one of SEQ ID NO: 3, 4, 6, 8, 10, 12, 14, 16, 18, 20, 22, 24, 26, 28, 243, or 245 of patent application WO2017/070622 or fragments or variants thereof, may be selected and may accordingly be understood as suitable coding sequence and may therefore be comprised in the artificial RNA of the first aspect of the invention.

In other embodiments, the artificial RNA of the first aspect may comprise or consist of at least one coding sequence encoding any one of SEQ ID NOs: 1-65, 81-95, 110-116 of patent application WO2017/172890 or fragments of variants thereof. It has to be understood that, on nucleic acid level, any nucleic acid sequence, in particular, any RNA sequence which encodes an amino acid sequences being identical to SEQ ID NOs: 1-65, 81-95, 110-116 of patent application WO2017/172890 or fragments or variants thereof, or any nucleic acid sequence (e.g. DNA sequence, RNA sequence) which encodes amino acid sequences being at least 70%, 80%, 85%, 86%, 87%, 88%, 89%, 90%, 91%, 92%, 93%, 94%, 95%, 96%, 97%, 98%, or 99% identical to any one of SEQ ID NOs: 1-65, 81-95, 110-116 of patent application WO2017/172890 or fragments or variants thereof, may be selected and may accordingly be understood as suitable coding sequence and may therefore be comprised in the artificial RNA of the first aspect of the invention.

Suitably, in particularly preferred embodiments, the artificial RNA of the first aspect comprises a coding sequence located between said 5'-UTR and said 3'-UTR, preferably downstream of said 5'-UTR and upstream of said 3'-UTR.

In preferred embodiments, the artificial RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 69-482, 484-897, 899-1266, 1268-1635, 1637-2004, 2006-2373, 2375-2742, 2744-3111, 3113-3480, 3482-3849, 3851-4218, 4220-4587, 4589-4956, 4958-5325, 5327-5694, 5696-6063, 6065-6432, 6434-6801, 6803-7170, 7172-7539, 7541-7908, 7910-8277, 8278, 11727-12094, 12096-12463, 12465-12832, 12834-13201, 13941-14308, 14310-14677, 14679-15046, 15048-15415, 15417-15784, 15786-16153, 13203-13570, 13572-13939, 16155-16522, 16524-16891, 16893-17260, 17262-17629, 17631-17998, 18000-17998, 18369-18736, 18738-19105, 19107-19474, 19476-19843, 21363-21706 or a fragment or a fragment or variant of any of these sequences (see also Table 3-6). Additional information regarding each of these suitable nucleic acid sequences encoding may also be derived from the sequence listing, in particular from the details provided therein under identifier <223>.

In particularly preferred embodiments, the artificial RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 69-77, 484-492, 899-906, 1268-1275, 1637-1644, 2006-2013, 2375-2382, 2744-2751, 3113-3120, 3482-3489, 3851-3858, 4220-4227, 4589-4596, 4958-4965, 5327-5334, 5696-5703, 6065-6072, 6434-6441, 6803-6810, 7172-7179, 7541-7548, 7910-7917, 21363-21384, 11727-11734, 12096-12103, 12465-12472, 12834-12841, 13941-13948, 14310-14317, 14679-14686, 15048-15055, 15417-15424, 15786-15793, 13203-13210, 13572-13579, 16155-16162, 16524-16531, 16893-16900, 17262-17269, 17631-17638, 18000-18007, 18369-18376, 18738-18745, 19107-19114, 19476-19483, 21389-21410 or a fragment or a fragment or variant of any of these sequences (see also Table 3 and 4). Additional information regarding each of these suitable nucleic acid sequences encoding may also be derived from the sequence listing, in particular from the details provided therein under identifier <223>.

In other embodiments, the artificial RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 383-388 of patent application WO2014/160463 or a fragment or a fragment or variant of any of these sequences.

In other embodiments, the artificial RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 12-22 of patent application WO2015/024668 or a fragment or a fragment or variant of any of these sequences.

In other embodiments, the artificial RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 1, 2, 5, 7, 9, 11, 13, 15, 17, 19, 21, 23, 25, 27, 242, 244, 246, 257, 258-280 of patent application WO2017/070622 or a fragment or a fragment or variant of any of these sequences.

In other embodiments, the artificial RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 96-99 of patent application WO2017/172890 or a fragment or a fragment or variant of any of these sequences.

According to preferred embodiments, the artificial RNA is a modified and/or stabilized artificial RNA.

According to preferred embodiments, the artificial RNA of the present invention may thus be provided as a "stabilized artificial RNA" that is to say an RNA showing improved resistance to in vivo degradation and/or an artificial RNA showing improved stability in vivo, and/or an artificial RNA showing improved translatability in vivo. In the following, specific suitable modifications in this context are described which are suitably to "stabilize" the artificial RNA.

Such stabilization may be effected by providing a "dried RNA" and/or a "purified RNA" as specified herein. Alternatively or in addition to that, such stabilization can be effected, for example, by a modified phosphate backbone of the artificial RNA of the present invention. A backbone modification in connection with the present invention is a modification in which phosphates of the backbone of the nucleotides contained in the RNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, suitable modifications are described that are capable of "stabilizing" the artificial RNA of the invention.

According to embodiments, the artificial RNA according to the invention is a modified artificial RNA, wherein the modification refers to chemical modifications comprising backbone modifications as well as sugar modifications or base modifications.

In this context, a modified artificial RNA as defined herein may contain nucleotide analogues/modifications, e.g. backbone modifications, sugar modifications or base modifications. A backbone modification in connection with the present invention is a modification, in which phosphates of the backbone of the nucleotides contained in a nucleic acid, e.g. an artificial RNA, are chemically modified. A sugar modification in connection with the present invention is a chemical modification of the sugar of the nucleotides of the RNA as defined herein. Furthermore, a base modification in connection with the present invention is a chemical modification of the base moiety of the nucleotides of the RNA. In this context, nucleotide analogues or modifications are preferably selected from nucleotide analogues which are applicable for transcription and/or translation.

In particularly preferred embodiments of the present invention, the nucleotide analogues/modifications which may be incorporated into a modified nucleic acid or particularly into a modified RNA as described herein are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine, 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, 5'-O-(1-thiophosphate)-adenosine, 5'-O-(1-thiophosphate)-cytidine, 5'-O-(1-thiophosphate)-guanosine, 5'-O-(1-thiophosphate)-uridine, 5'-O-(1-thiophosphate)-pseudouridine, 6-aza-cytidine, 2-thio-cytidine, alpha-thio-cytidine, Pseudo-iso-cytidine, 5-aminoallyl-uridine, 5-iodo-uridine, N1-methyl-pseudouridine, 5,6-dihydrouridine, alpha-thio-uridine, 4-thio-uridine, 6-aza-uridine, 5-hydroxy-uridine, deoxy-thymidine, 5-methyl-uridine, Pyrrolo-cytidine, inosine, alpha-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, alpha-thio-adenosine, 8-azido-adenosine, 7-deaza-adenosine. Particularly preferred and suitable in the context of the invention are pseudouridine (ψ), N1-methylpseudouridine (m1ψ), 5-methylcytosine, and 5-methoxyuridine. Accordingly, the artificial RNA as defined herein may comprise at least one modified nucleotide selected from pseudouridine (ψ), N1-methylpseudouridine (m1ψ), 5-methylcytosine, and 5-methoxyuridine.

In preferred embodiments, the artificial RNA of the invention comprises at least one coding sequence, wherein the at least one coding sequence is a pseudouridine (ψ) modified coding sequence.

Accordingly, in preferred embodiments, the artificial RNA of the invention, or the at least one coding sequence, comprises a nucleic acid sequence wherein at least one or more than one, preferably wherein all uracil nucleotides are replaced by pseudouridine (ψ) nucleotides In further preferred embodiments, the artificial RNA of the invention comprises at least one coding sequence, wherein the at least one coding sequence is a N1-methylpseudouridine (m1ψ) modified coding sequence.

Accordingly, in preferred embodiments, the artificial RNA of the invention, or the at least one coding sequence, comprises a nucleic acid sequence wherein at least one or more than one, preferably wherein all uracil nucleotides are replaced by N1-methylpseudouridine (m1ψ) nucleotides In preferred embodiments, the artificial RNA of the invention comprises at least one coding sequence, wherein the at least one coding sequence is a codon modified coding sequence.

In preferred embodiments, the at least one coding sequence of the invention is a codon modified coding sequence, wherein the amino acid sequence encoded by the at least one codon modified coding sequence is preferably not being modified compared to the amino acid sequence encoded by the corresponding wild type coding sequence.

The term "codon modified coding sequence" relates to coding sequences that differ in at least one codon (triplets of nucleotides coding for one amino acid) compared to the corresponding wild type coding sequence. Suitably, a codon modified coding sequence in the context of the invention may show improved resistance to in vivo degradation and/or improved stability in vivo, and/or improved translatability in vivo. Codon modifications in the broadest sense make use of the degeneracy of the genetic code wherein multiple codons may encode the same amino acid and may be used interchangeably (cf. Table 2) to optimize/modify the coding sequence for in vivo applications as outlined above.

In particularly preferred embodiments of the first aspect, the at least one sequence is a codon modified coding sequence, wherein the codon modified coding sequence is selected from C maximized coding sequence, CAI maximized coding sequence, human codon usage adapted coding sequence, G/C content modified coding sequence, and G/C optimized coding sequence, or any combination thereof, or any combination thereof.

According to preferred embodiments, the artificial RNA of the invention may be modified, wherein the C content of the at least one coding sequence may be increased, preferably maximized, compared to the C content of the corresponding wild type coding sequence (herein referred to as "C maximized coding sequence"). The amino acid sequence encoded by the C maximized coding sequence of the RNA is preferably not modified as compared to the amino acid sequence encoded by the respective wild type nucleic acid coding sequence. The generation of a C maximized nucleic acid sequences may suitably be carried out using a modification method according to WO2015/062738. In this context, the disclosure of WO2015/062738 is included herewith by reference. Throughout the disclosure of the invention, including the <223> identifier of the sequence listing, C maximized coding sequences of suitable RSV nucleic acid sequences are indicated by the abbreviation "opt2".

According to embodiments, the artificial RNA of the present invention may be modified, wherein the G/C content of the at least one coding sequence of the invention may be modified compared to the G/C content of the corresponding wild type coding sequence (herein referred to as "G/C content modified coding sequence"). In this context, the terms "G/C optimization" or "G/C content modification" relate to a nucleic acid, preferably an artificial nucleic acid of the invention that comprises a modified, preferably an increased number of guanosine and/or cytosine nucleotides as compared to the corresponding wild type nucleic acid sequence. Such an increased number may be generated by substitution of codons containing adenosine or thymidine nucleotides by codons containing guanosine or cytosine nucleotides. If the enriched G/C content occurs in a coding sequence of DNA or RNA, it makes use of the degeneracy of the genetic code. In particular, in case of RNA, sequences having an increased G (guanosine)/C (cytosine) content are more stable than sequences having an increased A (adenosine)/U (uracil) content. The amino acid sequence encoded by the G/C content modified coding sequence of the nucleic acid sequence is preferably not modified as compared to the amino acid sequence encoded by the respective wild type nucleic acid coding sequence. Preferably, the G/C content of the coding sequence of the artificial nucleic acid sequence, e.g. the RNA sequence of the present invention is increased by at least 10%, preferably by at least 20%, more preferably by at least 30%, most preferably by at least 40% compared to the G/C content of the coding sequence of the corresponding wild type nucleic acid sequence (e.g. RNA sequence), which codes for a RSV antigen as defined herein or a fragment or variant thereof.

According to preferred embodiments, the artificial RNA of the present invention may be modified, wherein the G/C content of the at least one coding sequence of the invention may be optimized compared to the G/C content of the corresponding wild type coding sequence (herein referred to as "G/C content optimized coding sequence"). "Optimized" in that context refers to a coding sequence wherein the G/C content is preferably increased to the essentially highest possible G/C content. The amino acid sequence encoded by the G/C content optimized coding sequence of the nucleic acid sequence is preferably not modified as compared to the amino acid sequence encoded by the respective wild type nucleic acid coding sequence. The generation of a G/C content optimized nucleic RNA sequence may suitably be carried out using a G/C content optimization method according to WO2002/098443. In this context, the disclosure of WO2002/098443 is included in its full scope in the present invention. Throughout the disclosure of the invention, including the <223> identifier of the sequence listing, G/C optimized coding sequences of suitable RSV nucleic acid sequences are indicated by the abbreviation "opt1, opt5, opt6, opt11".

According to embodiments, the artificial RNA of the invention may be modified, wherein the codons in the at least one coding sequence of the invention may be adapted to human codon usage (herein referred to as "human codon usage adapted coding sequence"). Codons encoding the same amino acid occur at different frequencies in a subject, e.g. a human. Accordingly, the coding sequence of the artificial RNA is preferably modified such that the frequency of the codons encoding the same amino acid corresponds to the naturally occurring frequency of that codon according to the human codon usage e.g. as shown in Table 2. For example, in the case of the amino acid Ala, the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 2). Accordingly, such a procedure (as exemplified for Ala) is applied for each amino acid encoded by the coding sequence of the artificial nucleic acid of the invention to obtain sequences adapted to human codon usage. Throughout the disclosure of the invention, including the <223> identifier of the sequence listing, human codon usage adapted coding sequences of suitable RSV nucleic acid sequences are indicated by the abbreviation "opt3".

TABLE 2

Human codon usage table with frequencies indicated for each amino acid

| Amino acid | codon | frequency |
|---|---|---|
| Ala | GCG | 0.10 |
| Ala | GCA | 0.22 |
| Ala | GCT | 0.28 |
| Ala | GCC* | 0.40 |
| Cys | TGT | 0.42 |
| Cys | TGC* | 0.58 |
| Asp | GAT | 0.44 |
| Asp | GAC* | 0.56 |
| Glu | GAG* | 0.59 |
| Glu | GAA | 0.41 |
| Phe | TTT | 0.43 |
| Phe | TTC* | 0.57 |
| Gly | GGG | 0.23 |
| Gly | GGA | 0.26 |
| Gly | GGT | 0.18 |
| Gly | GGC* | 0.33 |
| His | CAT | 0.41 |

TABLE 2-continued

Human codon usage table with frequencies indicated for each amino acid

| Amino acid | codon | frequency |
|---|---|---|
| His | CAC* | 0.59 |
| Ile | ATA | 0.14 |
| Ile | ATT | 0.35 |
| Ile | ATC* | 0.52 |
| Lys | AAG* | 0.60 |
| Lys | AAA | 0.40 |
| Leu | TTG | 0.12 |
| Leu | TTA | 0.06 |
| Leu | CTG* | 0.43 |
| Leu | CTA | 0.07 |
| Leu | CTT | 0.12 |
| Leu | CTC | 0.20 |
| Met | ATG* | 1 |
| Asn | AAT | 0.44 |
| Asn | AAC* | 0.56 |
| Pro | CCG | 0.11 |
| Pro | CCA | 0.27 |
| Pro | CCT | 0.29 |
| Pro | CCC* | 0.33 |
| Gln | CAG* | 0.73 |
| Gln | CAA | 0.27 |
| Arg | AGG | 0.22 |
| Arg | AGA* | 0.21 |
| Arg | CGG | 0.19 |
| Arg | CGA | 0.10 |
| Arg | CGT | 0.09 |
| Arg | CGC | 0.19 |
| Ser | AGT | 0.14 |
| Ser | AGC* | 0.25 |
| Ser | TCG | 0.06 |
| Ser | TCA | 0.15 |
| Ser | TCT | 0.18 |
| Ser | TCC | 0.23 |
| Thr | ACG | 0.12 |
| Thr | ACA | 0.27 |
| Thr | ACT | 0.23 |
| Thr | ACC* | 0.38 |
| Val | GTG* | 0.48 |

TABLE 2-continued

Human codon usage table with frequencies indicated for each amino acid

| Amino acid | codon | frequency |
|---|---|---|
| Val | GTA | 0.10 |
| Val | GTT | 0.17 |
| Val | GTC | 0.25 |
| Trp | TGG* | 1 |
| Tyr | TAT | 0.42 |
| Tyr | TAC* | 0.58 |
| Stop | TGA* | 0.61 |
| Stop | TAG | 0.17 |
| Stop | TAA | 0.22 |

*most frequent human codon

According to embodiments, the artificial RNA of the present invention may be modified, wherein the codon adaptation index (CAI) may be increased or preferably maximised in the at least one coding sequence of the invention (herein referred to as "CAI maximized coding sequence"). Accordingly, it is preferred that all codons of the wild type nucleic acid sequence that are relatively rare in e.g. a human cell are exchanged for a respective codon that is frequent in the e.g. a human cell, wherein the frequent codon encodes the same amino acid as the relatively rare codon. Suitably, the most frequent codons are used for each encoded amino acid (see Table 2, most frequent human codons are marked with asterisks). Suitably, the artificial RNA of the invention comprises at least one coding sequence, wherein the codon adaptation index (CAI) of the at least one coding sequence is at least 0.5, at least 0.8, at least 0.9 or at least 0.95. Most preferably, the codon adaptation index (CAI) of the at least one coding sequence is 1. For example, in the case of the amino acid Ala, the wild type coding sequence is adapted in a way that the most frequent human codon "GCC" is always used for said amino acid. Accordingly, such a procedure (as exemplified for Ala) is applied for each amino acid encoded by the coding sequence of the artificial RNA of the invention to obtain CAI maximized coding sequences. Throughout the disclosure of the invention including the <223> identifier of the sequence listing, CAI maximized coding sequences of suitable RSV nucleic acid sequences are indicated by the abbreviation "opt4".

Accordingly, in a particularly preferred embodiment, the artificial RNA of the first aspect comprises at least one coding sequence comprising a codon modified nucleic acid sequence which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 70-77, 485-492, 899-906, 1268-1275, 1637-1644, 2006-2013, 2375-2382, 2744-2751, 3113-3120, 3482-3489, 3851-3858, 4220-4227, 4589-4596, 4958-4965, 5327-5334, 5696-5703, 6065-6072, 6434-6441, 6803-6810, 7172-7179, 7541-7548, 7910-7917, 11728-11734, 12097-12103, 12465-12472, 12834-12841, 13941-13948, 14310-14317, 14679-14686, 15048-15055, 15417-15424, 15786-15793, 13203-13210, 13572-13579, 16155-16162, 16524-16531, 16893-

16900, 17262-17269, 17631-17638, 18000-18007, 18369-18376, 18738-18745, 19107-19114, 19476-19483, 21363-21384, 21389-21410 or a fragment or variant of any of these sequences (see also Table 3 and 4). Additional information regarding each of these suitable nucleic acid sequences encoding may also be derived from the sequence listing, in particular from the details provided therein under identifier <223>.

In particularly preferred embodiment, the artificial RNA of the first aspect comprises at least one coding sequence comprising a codon modified nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the G/C optimized or G/C content modified nucleic acid sequence according to the SEQ ID NOs: 70-71, 75-77, 485-486, 490-492, 899-900, 904-906, 1268-1269, 1273-1275, 1637-1638, 1642-1644, 2006-2007, 2011-2013, 2375-2376, 2380-2382, 2744-2745, 2749-2751, 3113-3114, 3118-3120, 3482-3483, 3487-3489, 3852, 4221, 4590, 4959, 5328, 5697, 6066, 6435, 6804, 7173, 7542, 7911, 3856-3858, 4225-4227, 4594-4596, 4963-4965, 5332-5334, 5701-5703, 6070-6072, 6439-6441, 6808-6810, 7177-7179, 7546-7548, 7915-7917, 11728, 11732-11734, 12097, 12101-12103, 12465, 12466, 12470-12472, 12834, 12835, 12839-12841, 13941, 13942, 13946-13948, 14310, 14311, 14315-14317, 14679, 14680, 14684-14686, 15048, 15049, 15053-15055, 15417, 15418, 15422-15424, 15786, 15787, 15791-15793, 13203, 13204, 13208-13210, 13572, 13573, 13577-13579, 16155, 16156, 16160-16162, 16524, 16525, 16529-16531, 16893, 16894, 16898-16900, 17262, 17263, 17267-17269, 17631, 17632, 17636-17638, 18000, 18001, 18005-18007, 18369, 18370, 18374-18376, 18738, 18739, 18743-18745, 19107, 19108, 19112-19114, 19476, 19477, 19481-19483, 21363-21384, 21389-21410 or a fragment or variant of any of these sequences (see also Table 3 and 4; opt1, 5, 6, 11). Additional information regarding each of these suitable nucleic acid sequences encoding may also be derived from the sequence listing, in particular from the details provided therein under identifier <223>.

In preferred embodiment, the artificial RNA of the invention comprises at least one coding sequence comprising a codon modified nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the human codon usage adapted nucleic acid sequence according to the SEQ ID NOs: 73, 488, 902, 1271, 1640, 2009, 2378, 2747, 3116, 3485, 3854, 4223, 4592, 4961, 5330, 5699, 6068, 6437, 6806, 7175, 7544, 7913, 11730, 12099, 12468, 12837, 13944, 14313, 14682, 15051, 15420, 15789, 13206, 13575, 16158, 16527, 16896, 17265, 17634, 18003, 18372, 18741, 19110, 19479 or a fragment or variant of any of these sequences (see also Table 3 and 4; opt3). Additional information regarding each of these suitable nucleic acid sequences encoding may also be derived from the sequence listing, in particular from the details provided therein under identifier <223>.

In particularly preferred embodiment, the artificial RNA of the first aspect comprises at least one coding sequence comprising a codon modified nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the C maximized nucleic acid sequence according to the SEQ ID NOs: 72, 487, 901, 1270, 1639, 2008, 2377, 2746, 3115, 3484, 3853, 4222, 4591, 4960, 5329, 5698, 6067, 6436, 6805, 7174, 7543, 7912, 11729, 12098, 12467, 12836, 13943, 14312, 14681, 15050, 15419, 15788, 13205, 13574, 16157, 16526, 16895, 17264, 17633, 18002, 18371, 18740, 19109, 19478 or a fragment or variant of any of these sequences (see also Table 3 and 4; opt2). Additional information regarding each of these suitable nucleic acid sequences encoding may also be derived from the sequence listing, in particular from the details provided therein under identifier <223>.

In preferred embodiment, the artificial RNA of the invention comprises at least one coding sequence comprising a codon modified nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the CAI maximized nucleic acid sequence according to the SEQ ID NOs 74, 489, 903, 1272, 1641, 2010, 2379, 2748, 3117, 3486, 3855, 4224, 4593, 4962, 5331, 5700, 6069, 6438, 6807, 7176, 7545, 7914, 11731, 12100, 12469, 12838, 13945, 14314, 14683, 15052, 15421, 15790, 13207, 13576, 16159, 16528, 16897, 17266, 17635, 18004, 18373, 18742, 19111, 19480 or a fragment or variant of any of these sequences (see also Table 3 and 4; opt4). Additional information regarding each of these suitable nucleic acid sequences encoding may also be derived from the sequence listing, in particular from the details provided therein under identifier <223>.

In embodiments, the A/U content in the environment of the ribosome binding site of the artificial nucleic acid, particularly the artificial RNA of the invention may be increased compared to the A/U content in the environment of the ribosome binding site of its respective wild type nucleic acid. This modification (an increased A/U content around the ribosome binding site) increases the efficiency of ribosome binding to the nucleic acid, preferably the RNA. An effective binding of the ribosomes to the ribosome binding site in turn has the effect of an efficient translation of the RNA. Accordingly, in a particularly preferred embodiment, the artificial nucleic acid of the invention comprises a ribosome binding site, also referred to as "Kozak sequence" identical to or at least 80%, 85%, 90%, 95% identical to any one of the sequences SEQ ID NOs: 41, 42, or fragments or variants thereof.

Preferred RSV polypeptide and nucleic acid coding sequences ("cds") are provided in Table 3A and 3B and Table 4A and 4B.

In Table 3A and 3B, Columns A to J represent specific suitable constructs of the invention derived from RSV Fusion (F) protein, wherein Column A provides suitable sequences for F0, Column B provides suitable sequences for F-del, Column C provides suitable sequences for F0_DSCav1, Column D provides suitable sequences for F-del_DSCav1, Column E provides suitable sequences for F_DSCav1_mut1, Column F provides suitable sequences for F-del_DSCav1_mut1, Column G provides suitable sequences for F_DSCav1_mut2, Column H provides suitable sequences for F-del_DSCav1_mut2, Column I provides suitable sequences for F_DSCav1_mut3, Column J provides suitable sequences for F-del_DSCav1_mut3. The specific protein SEQ ID NOs as provided in the sequence listing are in row 2 ("PRT"). The SEQ ID NOs of corresponding wild type/non-modified coding sequences are provided in row 3 ("wt"). The SEQ ID NOs of corresponding codon modified coding sequences for each protein construct are provided in row 4 to row 10 ("opt3", "opt2", "opt3", "opt4", "opt5", "opt6", "opt3"). In Table 3A, coding sequences derived from HRSV(A2) are provided, in Table 3B coding sequences derived from HRSV(Memphis-37) are provided. Further information is provided in the <223> identifier for each of the respective SEQ ID NO in the sequence listing.

TABLE 3A

Preferred coding sequences encoding RSV F (columns A-J), derived from HRSV(A2)

|  | A | B | C | D | E | F | G | H | I | J |
|---|---|---|---|---|---|---|---|---|---|---|
| PRT | 68 | 483 | 898 | 1267 | 1636 | 2005 | 2374 | 2743 | 3112 | 3481 |
| wt | 69 | 484 | | | | | | | | |
| opt1 | 70, 71, 21363 | 485, 486, 21364 | 899, 900, 21365 | 1268, 1269, 21366 | 1637, 1638, 21369 | 2006, 2007, 21370 | 2375, 2376, 21371 | 2744, 2745, 21372 | 3113, 3114, 21373 | 3482, 3483, 21374 |
| opt2 | 72 | 487 | 901 | 1270 | 1639 | 2008 | 2377 | 2746 | 3115 | 3484 |
| opt3 | 73 | 488 | 902 | 1271 | 1640 | 2009 | 2378 | 2747 | 3116 | 3485 |
| opt4 | 74 | 489 | 903 | 1272 | 1641 | 2010 | 2379 | 2748 | 3117 | 3486 |
| opt5 | 75 | 490 | 904 | 1273 | 1642 | 2011 | 2380 | 2749 | 3118 | 3487 |
| opt6 | 76 | 491 | 905 | 1274 | 1643 | 2012 | 2381 | 2750 | 3119 | 3488 |
| opt11 | 77 | 492 | 906 | 1275 | 1644 | 2013 | 2382 | 2751 | 3120 | 3489 |

TABLE 3B

Preferred coding sequences encoding RSV F (columns A-J), derived from HRSV(Memphis-37)

|  | A | B | C | D | E | F | G | H | I | J |
|---|---|---|---|---|---|---|---|---|---|---|
| PRT | 11726 | 12095 | 12464 | 12833 | 13940 | 14309 | 14678 | 15047 | 15416 | 15785 |
| wt | 11727 | 12096 | | | | | | | | |
| opt1 | 11728, 21389 | 12097, 21390 | 12465, 12466, 21391 | 12834, 12835, 21392 | 13941, 13942, 21395 | 14310, 14311, 21396 | 14679, 14680, 21397 | 15048, 15049, 21398 | 15417, 15418, 21399 | 15786, 15787, 21400 |
| opt2 | 11729 | 12098 | 12467 | 12836 | 13943 | 14312 | 14681 | 15050 | 15419 | 15788 |
| opt3 | 11730 | 12099 | 12468 | 12837 | 13944 | 14313 | 14682 | 15051 | 15420 | 15789 |
| opt4 | 11731 | 12100 | 12469 | 12838 | 13945 | 14314 | 14683 | 15052 | 15421 | 15790 |
| opt5 | 11732 | 12101 | 12470 | 12839 | 13946 | 14315 | 14684 | 15053 | 15422 | 15791 |
| opt6 | 11733 | 12102 | 12471 | 12840 | 13947 | 14316 | 14685 | 15054 | 15423 | 15792 |
| opt11 | 11734 | 12103 | 12472 | 12841 | 13948 | 14317 | 14686 | 15055 | 15424 | 15793 |

In Table 4A and 4B, Columns K to V represent specific suitable constructs of the invention derived from RSV Fusion (F) protein, wherein Column K provides suitable sequences for F_DSCav1_mut0, Column L provides suitable sequences for F-del_DSCav1_mut0, Column M provides suitable sequences for F_DSCav1_mut4, Column N provides suitable sequences for F-del_DSCav1_mut4, Column O provides suitable sequences for F_DSCav1_mut5, Column P provides suitable sequences for F-del_DSCav1_mut5, Column 0 provides suitable sequences for F_DSCav1_mut6, Column R provides suitable sequences for F-del_DSCav1_mut6, Column S provides suitable sequences for F_DSCav1_mut7, Column T provides suitable sequences for F-del_DSCav1_mut7, Column U provides suitable sequences for F_DSCav1_mut8, Column V provides suitable sequences for F-del_DSCav1_mut8. The specific protein SEQ ID NOs as provided in the sequence listing are in row 2 ("PRT"). The SEQ ID NOs of corresponding codon modified coding sequences for each protein construct are provided in row 3 to row 9 ("opt1", "opt2", "opt3", "opt4", "opt5", "opt6", "opt11"). In Table 4A, coding sequences derived from HRSV(A2) are provided, in Table 4B coding sequences derived from HRSV(Memphis-37) are provided. Further information is provided in the <223> identifier for each of the respective SEQ ID NO in the sequence listing.

TABLE 4A

Preferred coding sequences encoding RSV F (columns K-V), derived from HRSV(A2)

|  | K | L | M | N | O | P | Q | R | S | T | U | V |
|---|---|---|---|---|---|---|---|---|---|---|---|---|
| PRT | 3850 | 4219 | 4588 | 4957 | 5326 | 5695 | 6064 | 6433 | 6802 | 7171 | 7540 | 7909 |
| opt1 | 3851, 3852, 21367 | 4220, 4221, 21368 | 4589, 4590, 21375 | 4958, 4959, 21376 | 5327, 5328, 21377 | 5696, 5697, 21378 | 6065, 6066, 21379 | 6434, 6435, 21380 | 6803, 6804, 21381 | 7172, 7173, 21382 | 7541, 7542, 21383 | 7910, 7911, 21384 |
| opt2 | 3853 | 4222 | 4591 | 4960 | 5329 | 5698 | 6067 | 6436 | 6805 | 7174 | 7543 | 7912 |
| opt3 | 3854 | 4223 | 4592 | 4961 | 5330 | 5699 | 6068 | 6437 | 6806 | 7175 | 7544 | 7913 |
| opt4 | 3855 | 4224 | 4593 | 4962 | 5331 | 5700 | 6069 | 6438 | 6807 | 7176 | 7545 | 7914 |
| opt5 | 3856 | 4225 | 4594 | 4963 | 5332 | 5701 | 6070 | 6439 | 6808 | 7177 | 7546 | 7915 |
| opt6 | 3857 | 4226 | 4595 | 4964 | 5333 | 5702 | 6071 | 6440 | 6809 | 7178 | 7547 | 7916 |
| opt11 | 3858 | 4227 | 4596 | 4965 | 5334 | 5703 | 6072 | 6441 | 6810 | 7179 | 7548 | 7917 |

TABLE 4B

Preferred coding sequences encoding RSV F (columns K-V) derived from HRSV(Memphis-37)

|  | K | L | M | N | O | P | Q | R | S | T | U | V |
|---|---|---|---|---|---|---|---|---|---|---|---|---|
| PRT | 13202 | 13571 | 16154 | 16523 | 16892 | 17261 | 17630 | 17999 | 18368 | 18737 | 19106 | 19475 |
| opt1 | 13203, | 13572, | 16155, | 16524, | 16893, | 17262, | 17631, | 18000, | 18369, | 18738, |

001813, WO2015/034925 and WO2016/011222 are incorporated herewith by reference.

In embodiments, the artificial RNA is a replicon RNA. The term "replicon RNA" will be recognized and understood by the person of ordinary skill in the art, and are for example intended to be optimized self-replicating artificial RNA constructs. Such constructs include replication elements (replicase) derived from alphaviruses and the substitution of the structural virus proteins with the artificial nucleic acid of interest (in the context of the invention, an artificial nucleic acid comprising at least one coding sequence encoding at least one antigenic peptide or protein derived from RSV. Alternatively, the replicase may be provided on an independent construct comprising a replicase RNA sequence derived from e.g. Semliki forest virus (SFV), Sindbis virus (SIN), Venezuelan equine Encephalitis virus (VEE), Ross-River virus (RRV), or other viruses belonging to the alphavirus family. Downstream of the replicase lies a sub-genomic promoter that controls replication of the artificial nucleic acid of the invention, i.e. an artificial nucleic acid comprising at least one coding sequence encoding at least one antigenic peptide or protein derived from RSV.

In preferred embodiments the artificial RNA of the first aspect is an mRNA.

The terms "RNA" and "mRNA" will be recognized and understood by the person of ordinary skill in the art, and are for example intended to be a ribonucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. The mRNA (messenger RNA) usually provides the nucleotide sequence that may be translated into an amino-acid sequence of a particular peptide or protein.

The artificial RNA, preferably the mRNA of the invention may be prepared using any method known in the art, including chemical synthesis such as e.g. solid phase RNA synthesis, as well as in vitro methods, such as RNA in vitro transcription reactions.

In a preferred embodiment, the artificial RNA, preferably the mRNA is obtained by RNA in vitro transcription.

Accordingly, the RNA of the invention is preferably an in vitro transcribed RNA.

The terms "RNA in vitro transcription" or "in vitro transcription" relate to a process wherein RNA is synthesized in a cell-free system (in vitro). RNA may be obtained by DNA-dependent in vitro transcription of an appropriate DNA template, which according to the present invention is a linearized plasmid DNA template or a PCR-amplified DNA template. The promoter for controlling RNA in vitro transcription can be any promoter for any DNA-dependent RNA polymerase. Particular examples of DNA-dependent RNA polymerases are the T7, T3, SP6, or Syn5 RNA polymerases. In a preferred embodiment of the present invention the DNA template is linearized with a suitable restriction enzyme, before it is subjected to RNA in vitro transcription.

Reagents used in RNA in vitro transcription typically include: a DNA template (linearized plasmid DNA or PCR product) with a promoter sequence that has a high binding affinity for its respective RNA polymerase such as bacteriophage-encoded RNA polymerases (T7, T3, SP6, or Syn5); ribonucleotide triphosphates (NTPs) for the four bases (adenine, cytosine, guanine and uracil); optionally, a cap analogue as defined herein (e.g. m7G(5')ppp(5')G (m7G, m7G (5')ppp(5')(2'OMeG)pG or m7G(5')ppp(5')(2'OMeA)pG)); optionally, further modified nucleotides as defined herein; a DNA-dependent RNA polymerase capable of binding to the promoter sequence within the DNA template (e.g. T7, T3, SP6, or Syn5 RNA polymerase); optionally, a ribonuclease (RNase) inhibitor to inactivate any potentially contaminating RNase; optionally, a pyrophosphatase to degrade pyrophosphate, which may inhibit RNA in vitro transcription; MgCl2, which supplies Mg2+ ions as a co-factor for the polymerase; a buffer (TRIS or HEPES) to maintain a suitable pH value, which can also contain antioxidants (e.g. DTT), and/or polyamines such as spermidine at optimal concentrations, e.g. a buffer system comprising TRIS-Citrate as disclosed in WO2017/109161.

In embodiments, the nucleotide mixture used in RNA in vitro transcription may additionally contain modified nucleotides as defined herein. In that context, preferred modified nucleotides comprise pseudouridine (LP), N1-methylpseudouridine (m1ψ), 5-methylcytosine, and/or 5-methoxyuridine.

In preferred embodiments, the nucleotide mixture (i.e. the fraction of each nucleotide in the mixture) used for RNA in vitro transcription reactions may be optimized for the given RNA sequence, preferably as described WO2015/188933.

In embodiment where more than one different artificial RNA as defined herein has to be produced, e.g. where 2, 3, 4, 5, 6, 7, 8, 9, 10 or even more different artificial RNAs have to be produced (e.g. encoding different RSV F antigens, or e.g. a combination of RSV F and RSV G; see second aspect), procedures as described in WO2017/109134 may be suitably used.

In the context of RNA vaccine production, it may be required to provide GMP-grade RNA. GMP-grade RNA may be produced using a manufacturing process approved by regulatory authorities. Accordingly, in a particularly preferred embodiment, RNA production is performed under current good manufacturing practice (GMP), implementing various quality control steps on DNA and RNA level, preferably according to WO2016/180430. In preferred embodiments, the RNA of the invention is a GMP-grade RNA, particularly a GMP-grade mRNA.

The obtained RNA products are preferably purified using PureMessenger® (CureVac, Tübingen, Germany; RP-HPLC according to WO2008/077592) and/or tangential flow filtration (as described in WO2016/193206).

In a further preferred embodiment, the RNA, particularly the purified RNA, is lyophilized according to WO2016/165831 or WO2011/069586 to yield a temperature stable dried artificial RNA (powder) as defined herein. The RNA of the invention, particularly the purified RNA may also be dried using spray-drying or spray-freeze drying according to WO2016/184575 or WO2016184576 to yield a temperature stable RNA (powder) as defined herein. Accordingly, in the context of manufacturing and purifying RNA, the disclosures of WO2017/109161, WO2015/188933, WO2016/180430, WO2008/077592, WO2016/193206, WO2016/165831, WO2011/069586, WO2016/184575, and WO2016/184576 are incorporated herewith by reference.

Accordingly, in preferred embodiments, the RNA is a dried RNA, particularly a dried mRNA.

The term "dried RNA" as used herein has to be understood as RNA that has been lyophilized, or spray-dried, or spray-freeze dried as defined above to obtain a temperature stable dried RNA (powder).

In preferred embodiments, the artificial RNA of the invention is a purified RNA, particularly purified mRNA.

The term "purified RNA" or "purified mRNA" as used herein has to be understood as RNA which has a higher purity after certain purification steps (e.g. HPLC, TFF, Oligo d(T) purification, precipitation steps) than the starting material (e.g. in vitro transcribed RNA). Typical impurities that are essentially not present in purified RNA comprise peptides or proteins (e.g. enzymes derived from DNA dependent RNA in vitro transcription, e.g. RNA polymerases, RNases, pyrophosphatase, restriction endonuclease, DNase), spermidine, BSA, abortive RNA sequences, RNA fragments (short double stranded RNA fragments, abortive sequences etc.), free nucleotides (modified nucleotides, conventional NTPs, cap analogue), template DNA fragments, buffer components (HEPES, TRIS, MgCl2) etc. Other potential impurities that may be derived from e.g. fermentation procedures comprise bacterial impurities (bioburden, bacterial DNA) or impurities derived from purification procedures (organic solvents etc.). Accordingly, it is desirable in this regard for the "degree of RNA purity" to be as close as possible to 100%. It is also desirable for the degree of RNA purity that the amount of full-length RNA transcripts is as close as possible to 100%. Accordingly "purified RNA" as used herein has a degree of purity of more than 75%, 80%, 85%, very particularly 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target RNA and the total area of all peaks representing the by-products. Alternatively, the degree of purity may for example be determined by an analytical agarose gel electrophoresis or capillary gel electrophoresis.

It has to be understood that "dried RNA" as defined herein and "purified RNA" as defined herein or "GMP-grade mRNA" as defined herein may have superior stability characteristics (in vitro, in vivo) and improved efficiency (e.g. better translatability of the mRNA in vivo) and are therefore particularly suitable in the context of the invention. Moreover, "dried RNA" as defined herein and "purified RNA" as defined herein or "GMP-grade mRNA" may be particularly suitable for medical use as defined herein.

The artificial RNA may suitably be modified by the addition of a 5'-cap structure, which preferably stabilizes the nucleic acid as described herein. Accordingly, in preferred embodiments, the artificial RNA of the first aspect comprises a 5'-cap structure, preferably m7G, cap0 (e.g. m7G (5')ppp(5')G), cap1 (e.g. m7G(5')ppp(5')(2'OMeG) or m7G (5')ppp(5')(2'OMeA)), cap2, a modified cap0, or a modified cap1 structure (generated using a cap analogue as defined below).

The term "5'-cap structure" as used herein will be recognized and understood by the person of ordinary skill in the art, and is for example intended to refer to a modified nucleotide (cap analogue), particularly a guanine nucleotide, added to the 5'-end of an RNA molecule, e.g. an mRNA molecule. Preferably, the 5'-cap is added using a 5'-5'-triphosphate linkage (also named m7GpppN). Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety.

Further 5'-cap structures which may be suitable in the context of the present invention are cap1 (additional methylation of the ribose of the adjacent nucleotide of m7GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse cap analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

A 5'-cap (cap0 or cap1) structure may also be formed in chemical RNA synthesis or, preferably, RNA in vitro transcription (co-transcriptional capping) using cap analogues.

The term "cap analogue" as used herein will be recognized and understood by the person of ordinary skill in the art, and is for example intended to refer to a non-polymerizable di-nucleotide that has cap functionality in that it facilitates translation or localization, and/or prevents degradation of a nucleic acid molecule, particularly of an RNA molecule, when incorporated at the 5'-end of the nucleic acid molecule. Non-polymerizable means that the cap analogue will be incorporated only at the 5'-terminus because it does not have a 5' triphosphate and therefore cannot be extended in the 3'-direction by a template-dependent polymerase, particularly, by template-dependent RNA polymerase. Examples of cap analogues include, but are not limited to, a chemical structure selected from the group consisting of m7GpppG, m7GpppA, m7GpppC; unmethylated cap analogues (e.g. GpppG); dimethylated cap analogue (e.g. m2,7GpppG), trimethylated cap analogue (e.g. m2,2, 7GpppG), dimethylated symmetrical cap analogues (e.g. m7Gpppm7G), or anti reverse cap analogues (e.g. ARCA; m7,2'OmeGpppG, m7,2'dGpppG, m7,3'OmeGpppG, m7,3'dGpppG and their tetraphosphate derivatives). Further cap analogues have been described previously (WO2008/016473, WO2008/157688, WO2009/149253, WO2011/015347, and WO2013/059475). Further suitable cap analogons in that context are described in WO2017/066793, WO2017/066781, WO2017/066791, WO2017/066789, WO2017/053297, WO2017/066782, WO2018075827 and WO2017/066797 wherein the disclosures referring to cap analogues are incorporated herewith by reference.

The 5'-cap structure may suitably be added co-transcriptionally using cap-analogues as defined herein in an RNA in vitro transcription reaction as defined herein.

In preferred embodiments, a modified cap1 structure is generated using a cap analogue as disclosed in WO2017/053297, WO2017/066793, WO2017/066781, WO2017/066791, WO2017/066789, WO2017/066782, WO2018075827 and WO2017/066797. In particular, any cap structures derivable from the structure disclosed in claim 1-5 of WO2017/053297 may be suitably used to co-transcriptionally generate a modified cap1 structure. Further, any cap structures derivable from the structure defined in claim 1 or claim 21 of WO2018075827 may be suitably used to co-transcriptionally generate a modified cap1 structure.

Preferred cap-analogues are the di-nucleotide cap analogues m7G(5')ppp(5')G (m7G) or 3'-O-Me-m7G(5')ppp (5')G to co-transcriptionally generate cap0 structures. Particularly preferred cap-analogues are the tri-nucleotide cap analogues m7G(5')ppp(5')(2'OMeA)pG or m7G(5')ppp(5')(2'OMeG)pG to co-transcriptionally generate cap1 structures.

In that context, it is preferred that the RNA of the invention comprises a Cap1 structure as defined above, which preferably result in an increased protein expression through e.g. high capping efficiencies and increased translation efficiencies. Further suitably, the RNA of the invention comprising a Cap1 structure displays a decreased stimulation of the innate immune system as compared to Cap0 constructs of the same nucleic acid sequence. The person of ordinary skill knows how to determine translation efficiencies, capping degree, and immune stimulation.

In a particularly preferred embodiment, the artificial RNA of the first aspect of the invention comprises a cap1 structure, wherein said cap1 structure may be formed enzymatically or co-transcriptionally (e.g. using m7G(5')ppp(5')(2'OMeA)pG or m7G(5')ppp(5')(2'OMeG)pG analogues).

In preferred embodiments, the artificial RNA of the first aspect comprises an m7G(5')ppp(5')(2'OMeA)pG cap structure. In such embodiments, the coding RNA comprises a 5' terminal m7G cap, and an additional methylation of the ribose of the adjacent nucleotide of m7GpppN, in that case, a 2'O methylated adenosine.

In other preferred embodiments, the artificial RNA of the first aspect comprises an m7G(5')ppp(5')(2'OMeG)pG cap structure. In such embodiments, the coding RNA comprises a 5' terminal m7G cap, and an additional methylation of the ribose of the adjacent nucleotide, in that case, a 2'O methylated guanosine.

Accordingly, whenever reference is made to suitable RNA or mRNA sequences in the context of the invention, the first nucleotide of said RNA or mRNA sequence, that is the nucleotide downstream of the m7G(5')ppp structure, may be a 2'O methylated guanosine or a 2'O methylated adenosine.

Accordingly, in other embodiments, the artificial RNA of the invention may comprise a 5'-cap sequence element according to SEQ ID NOs: 43 or 21321, or a fragment or variant thereof.

In other embodiments, the 5'-cap structure is added via enzymatic capping using capping enzymes (e.g. vaccinia virus capping enzymes, commercially available capping kits) to generate cap0 or cap1 or cap2 structures. In other embodiments, the 5'-cap structure (cap0, cap1) is added via enzymatic capping using immobilized capping enzymes, e.g. using a capping reactor (WO2016/193226).

In preferred embodiments, the artificial RNA of the invention comprises at least one poly(A) sequence, preferably comprising 30 to 150 adenosine nucleotides.

In preferred embodiments, the poly(A) sequence, suitable located at the 3' terminus, comprises 10 to 500 adenosine nucleotides, 10 to 200 adenosine nucleotides, 40 to 200 adenosine nucleotides or 40 to 150 adenosine nucleotides. In a particularly preferred embodiment, the poly(A) sequence comprises about 64 adenosine nucleotides. In further particularly preferred embodiments, the poly(A) sequence comprises about 75 adenosine nucleotides. In further particularly preferred embodiments, the poly(A) sequence comprises about 100 adenosine nucleotides.

The terms "poly(A) sequence", "poly(A) tail" or "3'-poly(A) tail" as used herein will be recognized and understood by the person of ordinary skill in the art, and are for example intended to be a sequence of adenosine nucleotides, typically located at the 3'-end of an RNA, of up to about 1000 adenosine nucleotides. Preferably, said poly(A) sequence is essentially homopolymeric, e.g. a poly(A) sequence of e.g. 100 adenosine nucleotides has essentially the length of 100 nucleotides. In other embodiments, the poly(A) sequence may be interrupted by at least one nucleotide different from an adenosine nucleotide, e.g. a poly(A) sequence of e.g. 100 adenosine nucleotides may have a length of more than 100 nucleotides (comprising 100 adenosine nucleotides and in addition said at least one nucleotide different from an adenosine nucleotide).

In the context of the present invention, a poly(A) sequence may be located within an mRNA or any other nucleic acid molecule, such as, e.g., in a DNA vector, for example, in a vector serving as template for the generation of an RNA, preferably an mRNA, e.g., by transcription said DNA vector.

Preferably, the poly(A) sequence of the artificial RNA is obtained from a DNA template during RNA in vitro transcription. In other embodiments, the poly(A) sequence is obtained in vitro by common methods of chemical synthesis without being necessarily transcribed from a DNA template. In other embodiments, poly(A) sequences are generated by enzymatic polyadenylation of the RNA (after RNA in vitro transcription) using commercially available polyadenylation kits and corresponding protocols known in the art, or alternatively, by using immobilized poly(A)polymerases e.g. using a polyadenylation reactor (as described in WO2016/174271).

In embodiments, the artificial RNA of the invention may contain a poly(A) sequence derived from a vector and may comprise at least one additional poly(A) sequence generated by enzymatic polyadenylation, e.g. as described in WO2016/091391.

In preferred embodiments, the artificial RNA of the invention comprises at least one poly(C) sequence, preferably comprising 10 to 40 cytosine nucleotides.

In preferred embodiments, the poly(C) sequence, suitable located at the 3' terminus, comprises 10 to 200 cytosine nucleotides, 10 to 100 cytosine nucleotides, 20 to 70 cytosine nucleotides, 20 to 60 cytosine nucleotides, or 10 to 40 cytosine nucleotides. In a particularly preferred embodiment, the poly(C) sequence comprises about 30 cytosine nucleotides.

The term "poly(C) sequence" as used herein will be recognized and understood by the person of ordinary skill in the art, and are for example intended to be a sequence of cytosine nucleotides, typically located at the 3'-end of an RNA, of up to about 200 cytosine nucleotides. In the context of the present invention, a poly(C) sequence may be located within an mRNA or any other nucleic acid molecule, such as, e.g., in a DNA vector, for example, in a vector serving as template for the generation of an RNA, preferably an mRNA, e.g., by transcription of the vector.

Preferably, the poly(C) sequence in the RNA sequence of the present invention is derived from a DNA template by RNA in vitro transcription. In other embodiments, the poly(C) sequence is obtained in vitro by common methods of chemical synthesis without being necessarily transcribed from a DNA template.

In other embodiments, the artificial RNA of the invention does not comprises a poly(C) sequence as defined herein.

In preferred embodiments, the artificial RNA of the first aspect comprises at least one histone stem-loop.

The term "histone stem-loop" as used herein will be recognized and understood by the person of ordinary skill in the art, and are for example intended to refer to nucleic acid sequences that are predominantly found in histone mRNAs.

Exemplary histone stem-loop sequences are described in Lopez et al. (Davila Lopez et al, (2008), RNA, 14(1)). The stem-loops in histone pre-mRNAs are typically followed by a purine-rich sequence known as the histone downstream element (HIDE). These pre-mRNAs are processed in the nucleus by a single endonucleolytic cleavage approximately 5 nucleotides downstream of the stem-loop, catalysed by the U7 snRNP through base pairing of the U7 snRNA with the HDE.

Histone stem-loop sequences/structures may suitably be selected from histone stem-loop sequences as disclosed in WO2012/019780, the disclosure relating to histone stem-loop sequences/structures incorporated herewith by reference. A histone stem-loop sequence that may be used within the present invention may preferably be derived from formulae (I) or (II) of the patent application WO2012/019780. According to a further preferred embodiment the RNA as defined herein may comprise at least one histone stem-loop sequence derived from at least one of the specific formulae (Ia) or (IIa) of the patent application WO2012/019780.

In particularly preferred embodiment, the artificial RNA of the invention comprises at least one histone stem-loop, wherein said histone stem-loop comprises a nucleic acid sequence according to SEQ ID NO: 39 or 40 or a fragments or variant thereof.

In other embodiments, the artificial RNA of the first aspect does not comprises a histone stem-loop as defined herein.

In further embodiments, the artificial RNA of the invention comprises a 3'-terminal sequence element. Said 3'-terminal sequence element has to be understood as a sequence element comprising a poly(A)sequence and a histone-stem-loop sequence, wherein said sequence element is located at the 3' terminus of the artificial RNA of the invention.

In other embodiments, the artificial RNA of the invention may comprise a 3'-terminal sequence element according to SEQ ID NOs: 44-63 or 21322-21328 or a fragment or variant thereof.

In preferred embodiments, the artificial RNA of the invention comprises at least one pseudouridine (ψ) modified coding sequence.

Accordingly, in preferred embodiments, the artificial RNA of the invention, or the at least one coding sequence, comprises a nucleic acid sequence wherein at least one or more than one, preferably wherein all uracil nucleotides are replaced by pseudouridine (ψ) nucleotides.

In further preferred embodiments, the artificial RNA of the invention comprises at least one N1-methylpseudouridine (m1ψ) modified coding sequence.

Accordingly, in preferred embodiments, the artificial RNA of the invention, or the at least one coding sequence, comprises a nucleic acid sequence wherein at least one or more than one, preferably wherein all uracil nucleotides are replaced by N1-methylpseudouridine (m1ψ) nucleotides In preferred embodiments of the first aspect, the artificial RNA, preferably mRNA comprises preferably in 5'- to 3'-direction the following elements a)-i):
a) 5'-cap structure, preferably as specified herein;
b) optionally, 5'-UTR as specified herein, preferably at least one selected from SEQ ID NOs: 1-22;
c) a ribosome binding site, preferably as specified herein
d) at least one coding sequence as specified herein, preferably as specified in Table 3 and Table 4;
e) 3'-UTR as specified herein, preferably at least one selected from SEQ ID NOs: 23-38;
f) optionally, a poly(A) sequence, preferably as specified herein;
g) optionally, a poly(C) sequence, preferably as specified herein;
h) optionally, a histone stem-loop, preferably as specified herein;
i) optionally, a 3'-terminal sequence element as specified herein, preferably according to according to SEQ ID NOs: 44-63, or 21322-21328; and
wherein optionally at least one or more than one, preferably wherein all uracil nucleotides are replaced by pseudouridine (ψ) nucleotides or N1-methylpseudouridine (m1ψ) nucleotides.

In further preferred embodiments of the first aspect, the artificial RNA, preferably mRNA comprises the following elements preferably in 5'- to 3'-direction:
a) 5'-cap structure, preferably as specified herein, most preferably a Cap1 structure;
b) a 3'-UTR and a 5'-UTR element according to a-1, a-4, c-1, e-4, g-2, i-2, or i-3 as specified herein;
c) a ribosome binding site, preferably as specified herein;
d) at least one coding sequence as specified herein, wherein said coding sequence is located between said 5'-UTR and said 3'-UTR, preferably downstream of said 5'-UTR and upstream of said 3'-UTR, wherein the coding sequence is preferably selected from any one specified in Table 3 and Table 4;
e) optionally, a poly(A) sequence, preferably as specified herein;
f) optionally, poly(C) sequence, preferably as specified herein;
g) optionally, histone stem-loop, preferably as specified herein;
h) optionally, a 3'-terminal sequence element as specified herein, preferably according to according to SEQ ID NOs: 44-63, 21322-21328, and
wherein optionally at least one or more than one, preferably wherein all uracil nucleotides are replaced by pseudouridine (ψ) nucleotides or N1-methylpseudouridine (m1ψ) nucleotides.

In further preferred embodiments of the first aspect, the artificial RNA, preferably mRNA comprises the following elements preferably in 5'- to 3'-direction:
a) 5'-cap structure, preferably as specified herein, most preferably a Cap1 structure;
b) a 3'-UTR and a 5'-UTR element according to a-1 or i-3 as specified herein;
c) a ribosome binding site, preferably as specified herein
d) at least one coding sequence as specified herein, wherein said coding sequence is located between said 5'-UTR and said 3'-UTR, preferably downstream of said 5'-UTR and upstream of said 3'-UTR, wherein the coding sequence is preferably selected from any one specified in Table 3 and Table 4;
e) optionally, a histone stem-loop, preferably as specified herein;
f) a poly(A) sequence, preferably comprising about 100 adenosine nucleotides;
g) optionally, a 3'-terminal sequence element as specified herein, preferably according to according to SEQ ID NOs: 21322-21328, and
wherein optionally at least one or more than one, preferably wherein all uracil nucleotides are replaced by pseudouridine (ψ) nucleotides or N1-methylpseudouridine (m1ψ) nucleotides.

In further preferred embodiments of the first aspect, the artificial RNA, preferably mRNA comprises the following elements in 5'- to 3'-direction:
a) 5'-cap structure, preferably as specified herein, most preferably a Cap1 structure;
b) a 3'-UTR and a 5'-UTR element according to a-1, a-4, c-1, e-4, g-2, i-2, or i-3 as specified herein;
c) a ribosome binding site, preferably as specified herein;
d) at least one coding sequence as specified herein, wherein said coding region is located between said 5'-UTR and said 3'-UTR, preferably downstream of said 5'-UTR and upstream of said 3'-UTR, wherein the coding sequence is preferably selected from any one of SEQ ID NOs: 69-77, 484-492, 899-906, 1268-1275, 1637-1644, 2006-2013, 2375-2382, 2744-2751, 3113-3120, 3482-3489, 3851-3858, 4220-4227, 4589-4596, 4958-4965, 5327-5334, 5696-5703, 6065-6072, 6434-6441, 6803-6810, 7172-7179, 7541-7548, 7910-7917, 11727-11734, 12096-12103, 12465-12472, 12834-12841, 13941-13948, 14310-14317, 14679-14686, 15048-15055, 15417-15424, 15786-15793, 13203-13210, 13572-13579, 16155-16162, 16524-16531, 16893-16900, 17262-17269, 17631-17638, 18000-18007, 18369-18376, 18738-18745, 19107-19114, 19476-19483, 21363-21384, 21389-21410 (or fragments or variants thereof);
e) a poly(A) sequence comprising about 64 adenosine;
f) a poly(C) sequence comprising about 30 cysteines;
g) a histone stem-loop according to SEQ ID NO: 39 or 40, and
wherein optionally at least one or more than one, preferably wherein all uracil nucleotides are replaced by pseudouridine (ψ) nucleotides or N1-methylpseudouridine (m1ψ) nucleotides.

In further preferred embodiments of the first aspect, the artificial RNA, preferably mRNA comprises the following elements in 5'- to 3'-direction:
a) 5'-cap structure, preferably as specified herein, most preferably a Cap1 structure;
b) a 3'-UTR and a 5'-UTR element according to a-1, a-4, c-1, e-4, g-2, i-2, or i-3 as specified herein;
c) a ribosome binding site, preferably as specified herein;
d) at least one coding sequence as specified herein, wherein said coding region is located between said 5'-UTR and said 3'-UTR, preferably downstream of said 5'-UTR and upstream of said 3'-UTR, wherein the coding sequence is preferably selected from any one of SEQ ID NOs: 69-77, 484-492, 899-906, 1268-1275, 1637-1644, 2006-2013, 2375-2382, 2744-2751, 3113-3120, 3482-3489, 3851-3858, 4220-4227, 4589-4596, 4958-4965, 5327-5334, 5696-5703, 6065-6072, 6434-6441, 6803-6810, 7172-7179, 7541-7548, 7910-7917, 11727-11734, 12096-12103, 12465-12472, 12834-12841, 13941-13948, 14310-14317, 14679-14686, 15048-15055, 15417-15424, 15786-15793, 13203-13210, 13572-13579, 16155-16162, 16524-16531, 16893-16900, 17262-17269, 17631-17638, 18000-18007, 18369-18376, 18738-18745, 19107-19114, 19476-19483, 21363-21384, 21389-21410 (or fragments or variants thereof);
e) a poly(A) sequence comprising about 64 adenosine;
f) a histone stem-loop according to SEQ ID NO: 39 or 40, and wherein optionally at least one or more than one, preferably wherein all uracil nucleotides are replaced by pseudouridine (ψ) nucleotides or N1-methylpseudouridine (m1ψ) nucleotides.

Preferred RSV polypeptide, nucleic acid, and mRNA sequences are provided in Table 5A, 5B and Table 6A, 6B.

In Table 5A and 5B, the protein designs are indicated in row 1. Therein, Columns A to J represent specific suitable constructs of the invention derived from RSV Fusion (F) protein, wherein Column A provides suitable sequences for F0, Column B provides suitable sequences for F-del, Column C provides suitable sequences for F0_DSCav1, Column D provides suitable sequences for F-del_DSCav1, Column E provides suitable sequences for F_DSCav1_mut1, Column F provides suitable sequences for F-del_DSCav1_mut1, Column G provides suitable sequences for F_DSCav1_mut2, Column H provides suitable sequences for F-del_DSCav1_mut2, Column I provides suitable sequences for F_DSCav1_mut3, Column J provides suitable sequences for F-del_DSCav1_mut3.

The protein designs are indicated in row 1 (Columns A to J), the specific protein SEQ ID NOs as provided in the sequence listing are in row 2 ("protein"). The SEQ ID NOs of corresponding coding sequences for each protein construct are provided in row 3 ("cds", compare with Table 3 for different cds optimizations). Further information e.g. regarding the type of codon modified coding sequence (opt1, opt2, opt3, opt4, opt5, opt6, opt11 etc.) is provided in the <223> identifier of the respective SEQ ID NO in the sequence listing and in Table 3. The SEQ ID NOs of corresponding mRNA constructs comprising said coding sequences and suitable 3'-UTRs and 5'-UTRs according to the invention are provided in rows 4 to 47 (mRNA designs a-1 to i-3 as specified herein). In Table 5A, mRNA sequences derived from HRSV(A2) are provided, in Table 5B mRNA sequences derived from HRSV(Memphis-37) are provided. Further information e.g. regarding the type of coding sequence (wt, opt1, opt2, opt3, opt4, opt5, opt6, opt11 etc.) comprised in the mRNA constructs is provided in the <223> identifier of the respective SEQ ID NO in the sequence listing.

TABLE 5A

Preferred mRNA constructs encoding RSV F (columns A-J), derived from HRSV(A2)

| 1 | | A | B | C | D | E | F | G | H | I | J |
|---|---|---|---|---|---|---|---|---|---|---|---|
| 2 | Protein | 68 | 483 | 898 | 1267 | 1636 | 2005 | 2374 | 2743 | 3112 | 3481 |
| 3 | cds | 69-77, 21363 | 484-492, 21364 | 899-906, 21365 | 1268-1275, 21366 | 1637-1644, 21369 | 2006-2013, 21370 | 2375-2382, 21371 | 2744-2751, 21372 | 3113-3120, 21373 | 3482-3489, 21374 |
| 4 | mRNA Design a-1 | 78-86, 21415-21417, 21561-21563 | 493-501, 21418-21420, 21564-21566 | 907-914, 21421-21423, 21567-21569 | 1276-1283, 21424-21426, 21570-21572 | 1645-1652, 21433-21435, 21579-21581 | 2014-2021, 21436-21438, 21582-21584 | 2383-2390, 21439-21441, 21585-21587 | 2752-2759, 21442-21444, 21588-21590 | 3121-3128, 21445-21447, 21591-21593 | 3490-3497, 21448-21450, 21594-21596 |

TABLE 5A-continued

Preferred mRNA constructs encoding RSV F (columns A-J), derived from HRSV(A2)

| 1 | | A | B | C | D | E | F | G | H | I | J |
|---|---|---|---|---|---|---|---|---|---|---|---|
| 5 | mRNA Design a-2 | 87-95 | 502-510 | 915-922 | 1284-1291 | 1653-1660 | 2022-2029 | 2391-2398 | 2760-2767 | 3129-3136 | 3498-3505 |
| 6 | mRNA Design a-3 | 96-104 | 511-519 | 923-930 | 1292-1299 | 1661-1668 | 2030-2037 | 2399-2406 | 2768-2775 | 3137-3144 | 3506-3513 |
| 7 | mRNA Design a-4 | 105-113 | 520-528 | 931-938 | 1300-1307 | 1669-1676 | 2038-2045 | 2407-2414 | 2776-2783 | 3145-3152 | 3514-3521 |
| 8 | mRNA Design a-5 | 114-122 | 529-537 | 939-946 | 1308-1315 | 1677-1684 | 2046-2053 | 2415-2422 | 2784-2791 | 3153-3160 | 3522-3529 |
| 9 | mRNA Design b-1 | 123-131 | 538-546 | 947-954 | 1316-1323 | 1685-1692 | 2054-2061 | 2423-2430 | 2792-2799 | 3161-3168 | 3530-3537 |
| 10 | mRNA Design b-2 | 132-140 | 547-555 | 955-962 | 1324-1331 | 1693-1700 | 2062-2069 | 2431-2438 | 2800-2807 | 3169-3176 | 3538-3545 |
| 11 | mRNA Design b-3 | 141-149 | 556-564 | 963-970 | 1332-1339 | 1701-1708 | 2070-2077 | 2439-2446 | 2808-2815 | 3177-3184 | 3546-3553 |
| 12 | mRNA Design b-4 | 150-158 | 565-573 | 971-978 | 1340-1347 | 1709-1716 | 2078-2085 | 2447-2454 | 2816-2823 | 3185-3192 | 3554-3561 |
| 13 | mRNA Design b-5 | 159-167 | 574-582 | 979-986 | 1348-1355 | 1717-1724 | 2086-2093 | 2455-2462 | 2824-2831 | 3193-3200 | 3562-3569 |
| 14 | mRNA Design c-1 | 168-176 | 583-591 | 987-994 | 1356-1363 | 1725-1732 | 2094-2101 | 2463-2470 | 2832-2839 | 3201-3208 | 3570-3577 |
| 15 | mRNA Design c-2 | 177-185 | 592-600 | 995-1002 | 1364-1371 | 1733-1740 | 2102-2109 | 2471-2478 | 2840-2847 | 3209-3216 | 3578-3585 |
| 16 | mRNA Design c-3 | 186-194 | 601-609 | 1003-1010 | 1372-1379 | 1741-1748 | 2110-2117 | 2479-2486 | 2848-2855 | 3217-3224 | 3586-3593 |
| 17 | mRNA Design c-4 | 195-203 | 610-618 | 1011-1018 | 1380-1387 | 1749-1756 | 2118-2125 | 2487-2494 | 2856-2863 | 3225-3232 | 3594-3601 |
| 18 | mRNA Design c-5 | 204-212 | 619-627 | 1019-1026 | 1388-1395 | 1757-1764 | 2126-2133 | 2495-2502 | 2864-2871 | 3233-3240 | 3602-3609 |
| 19 | mRNA Design d-1 | 213-221 | 628-636 | 1027-1034 | 1396-1403 | 1765-1772 | 2134-2141 | 2503-2510 | 2872-2879 | 3241-3248 | 3610-3617 |
| 20 | mRNA Design d-2 | 222-230 | 637-645 | 1035-1042 | 1404-1411 | 1773-1780 | 2142-2149 | 2511-2518 | 2880-2887 | 3249-3256 | 3618-3625 |
| 21 | mRNA Design d-3 | 231-239 | 646-654 | 1043-1050 | 1412-1419 | 1781-1788 | 2150-2157 | 2519-2526 | 2888-2895 | 3257-3264 | 3626-3633 |
| 22 | mRNA Design d-4 | 240-248 | 655-663 | 1051-1058 | 1420-1427 | 1789-1796 | 2158-2165 | 2527-2534 | 2896-2903 | 3265-3272 | 3634-3641 |
| 23 | mRNA Design d-5 | 249-257 | 664-672 | 1059-1066 | 1428-1435 | 1797-1804 | 2166-2173 | 2535-2542 | 2904-2911 | 3273-3280 | 3642-3649 |
| 24 | mRNA Design e-1 | 258-266 | 673-681 | 1067-1074 | 1436-1443 | 1805-1812 | 2174-2181 | 2543-2550 | 2912-2919 | 3281-3288 | 3650-3657 |
| 25 | mRNA Design e-2 | 267-275 | 682-690 | 1075-1082 | 1444-1451 | 1813-1820 | 2182-2189 | 2551-2558 | 2920-2927 | 3289-3296 | 3658-3665 |
| 26 | mRNA Design e-3 | 276-284 | 691-699 | 1083-1090 | 1452-1459 | 1821-1828 | 2190-2197 | 2559-2566 | 2928-2935 | 3297-3304 | 3666-3673 |
| 27 | mRNA Design e-4 | 285-293 | 700-708 | 1091-1098 | 1460-1467 | 1829-1836 | 2198-2205 | 2567-2574 | 2936-2943 | 3305-3312 | 3674-3681 |
| 28 | mRNA Design e-5 | 294-302 | 709-717 | 1099-1106 | 1468-1475 | 1837-1844 | 2206-2213 | 2575-2582 | 2944-2951 | 3313-3320 | 3682-3689 |
| 29 | mRNA Design e-6 | 303-311 | 718-726 | 1107-1114 | 1476-1483 | 1845-1852 | 2214-2221 | 2583-2590 | 2952-2959 | 3321-3328 | 3690-3697 |
| 30 | mRNA Design f-1 | 312-320 | 727-735 | 1115-1122 | 1484-1491 | 1853-1860 | 2222-2229 | 2591-2598 | 2960-2967 | 3329-3336 | 3698-3705 |
| 31 | mRNA Design f-2 | 321-329 | 736-744 | 1123-1130 | 1492-1499 | 1861-1868 | 2230-2237 | 2599-2606 | 2968-2975 | 3337-3344 | 3706-3713 |
| 32 | mRNA Design f-3 | 330-338 | 745-753 | 1131-1138 | 1500-1507 | 1869-1876 | 2238-2245 | 2607-2614 | 2976-2983 | 3345-3352 | 3714-3721 |
| 33 | mRNA Design f-4 | 339-347 | 754-762 | 1139-1146 | 1508-1515 | 1877-1884 | 2246-2253 | 2615-2622 | 2984-2991 | 3353-3360 | 3722-3729 |
| 34 | mRNA Design f-5 | 348-356 | 763-771 | 1147-1154 | 1516-1523 | 1885-1892 | 2254-2261 | 2623-2630 | 2992-2999 | 3361-3368 | 3730-3737 |
| 35 | mRNA Design g-1 | 357-365 | 772-780 | 1155-1162 | 1524-1531 | 1893-1900 | 2262-2269 | 2631-2638 | 3000-3007 | 3369-3376 | 3738-3745 |
| 36 | mRNA Design g-2 | 366-374 | 781-789 | 1163-1170 | 1532-1539 | 1901-1908 | 2270-2277 | 2639-2646 | 3008-3015 | 3377-3384 | 3746-3753 |
| 37 | mRNA Design g-3 | 375-383 | 790-798 | 1171-1178 | 1540-1547 | 1909-1916 | 2278-2285 | 2647-2654 | 3016-3023 | 3385-3392 | 3754-3761 |
| 38 | mRNA Design g-4 | 384-392 | 799-807 | 1179-1186 | 1548-1555 | 1917-1924 | 2286-2293 | 2655-2662 | 3024-3031 | 3393-3400 | 3762-3769 |
| 39 | mRNA Design g-5 | 393-401 | 808-816 | 1187-1194 | 1556-1563 | 1925-1932 | 2294-2301 | 2663-2670 | 3032-3039 | 3401-3408 | 3770-3777 |
| 40 | mRNA Design h-1 | 402-410 | 817-825 | 1195-1202 | 1564-1571 | 1933-1940 | 2302-2309 | 2671-2678 | 3040-3047 | 3409-3416 | 3778-3785 |
| 41 | mRNA Design h-2 | 411-419 | 826-834 | 1203-1210 | 1572-1579 | 1941-1948 | 2310-2317 | 2679-2686 | 3048-3055 | 3417-3424 | 3786-3793 |
| 42 | mRNA Design h-3 | 420-428 | 835-843 | 1211-1218 | 1580-1587 | 1949-1956 | 2318-2325 | 2687-2694 | 3056-3063 | 3425-3432 | 3794-3801 |

TABLE 5A-continued

Preferred mRNA constructs encoding RSV F (columns A-J), derived from HRSV(A2)

| 1 | | A | B | C | D | E | F | G | H | I | J |
|---|---|---|---|---|---|---|---|---|---|---|---|
| 43 | mRNA Design h-4 | 429-437 | 844-852 | 1219-1226 | 1588-1595 | 1957-1964 | 2326-2333 | 2695-2702 | 3064-3071 | 3433-3440 | 3802-3809 |
| 44 | mRNA Design h-5 | 438-446 | 853-861 | 1227-1234 | 1596-1603 | 1965-1972 | 2334-2341 | 2703-2710 | 3072-3079 | 3441-3448 | 3810-3817 |
| 45 | mRNA Design i-1 | 447-455 | 862-870 | 1235-1242 | 1604-1611 | 1973-1980 | 2342-2349 | 2711-2718 | 3080-3087 | 3449-3456 | 3818-3825 |
| 46 | mRNA Design i-2 | 456-473 | 871-888 | 1243-1258 | 1612-1627 | 1981-1996 | 2350-2365 | 2719-2734 | 3088-3103 | 3457-3472 | 3826-3841 |
| 47 | mRNA Design i-3 | 474-482 | 889-897 | 1259-1266 | 1628-1635 | 1997-2004 | 2366-2373 | 2735-2742 | 3104-3111 | 3473-3480 | 3842-3849 |
| 48 | mRNA Design i-4 | | | | 8278 | | | | | | |

TABLE 5B

Preferred mRNA constructs encoding RSV F (columns A-J), derived from HRSV(Memphis-37)

| 1 | | A | B | C | D | E | F | G | H | I | J |
|---|---|---|---|---|---|---|---|---|---|---|---|
| 2 | Protein | 11726 | 12095 | 12464 | 12833 | 13940 | 14309 | 14678 | 15047 | 15416 | 15785 |
| 3 | cds | 11727-11734, 21389 | 12096-12103, 21390 | 12465-12472, 21391 | 12834-12841, 21392 | 13941-13948, 21395 | 14310-14317, 21396 | 14679-14686, 21397 | 15048-15055, 21398 | 15417-15424, 21399 | 15786-15793, 21400 |
| 4 | mRNA Design a-1 | 11735-11742, 21489, 21490, 21635-21636 | 12104-12111, 21491, 21492, 21637-21638 | 12473-12480, 21493, 21495, 21639-21641 | 12842-12849, 21496, 21498, 21642-21644 | 13949-13956, 21505-21507, 21651-21653 | 14318-14325, 21508-21510, 21654-21656 | 14687-14694, 21511-21513, 21657-21659 | 15056-15063, 21514-21516, 21660-21662 | 15425-15432, 21517-21519, 21663-21665 | 15794-15801, 21520-21522, 21666-21668 |
| 5 | mRNA Design a-2 | 11743-11750 | 12112-12119 | 12481-12488 | 12850-12857 | 13957-13964 | 14326-14333 | 14695-14702 | 15064-15071 | 15433-15440 | 15802-15809 |
| 6 | mRNA Design a-3 | 11751-11758 | 12120-12127 | 12489-12496 | 12858-12865 | 13965-13972 | 14334-14341 | 14703-14710 | 15072-15079 | 15441-15448 | 15810-15817 |
| 7 | mRNA Design a-4 | 11759-11766 | 12128-12135 | 12497-12504 | 12866-12873 | 13973-13980 | 14342-14349 | 14711-14718 | 15080-15087 | 15449-15456 | 15818-15825 |
| 8 | mRNA Design a-5 | 11767-11774 | 12136-12143 | 12505-12512 | 12874-12881 | 13981-13988 | 14350-14357 | 14719-14726 | 15088-15095 | 15457-15464 | 15826-15833 |
| 9 | mRNA Design b-1 | 11775-11782 | 12144-12151 | 12513-12520 | 12882-12889 | 13989-13996 | 14358-14365 | 14727-14734 | 15096-15103 | 15465-15472 | 15834-15841 |
| 10 | mRNA Design b-2 | 11783-11790 | 12152-12159 | 12521-12528 | 12890-12897 | 13997-14004 | 14366-14373 | 14735-14742 | 15104-15111 | 15473-15480 | 15842-15849 |
| 11 | mRNA Design b-3 | 11791-11798 | 12160-12167 | 12529-12536 | 12898-12905 | 14005-14012 | 14374-14381 | 14743-14750 | 15112-15119 | 15481-15488 | 15850-15857 |
| 12 | mRNA Design b-4 | 11799-11806 | 12168-12175 | 12537-12544 | 12906-12913 | 14013-14020 | 14382-14389 | 14751-14758 | 15120-15127 | 15489-15496 | 15858-15865 |
| 13 | mRNA Design b-5 | 11807-11814 | 12176-12183 | 12545-12552 | 12914-12921 | 14021-14028 | 14390-14397 | 14759-14766 | 15128-15135 | 15497-15504 | 15866-15873 |
| 14 | mRNA Design c-1 | 11815-11822 | 12184-12191 | 12553-12560 | 12922-12929 | 14029-14036 | 14398-14405 | 14767-14774 | 15136-15143 | 15505-15512 | 15874-15881 |
| 15 | mRNA Design c-2 | 11823-11830 | 12192-12199 | 12561-12568 | 12930-12937 | 14037-14044 | 14406-14413 | 14775-14782 | 15144-15151 | 15513-15520 | 15882-15889 |
| 16 | mRNA Design c-3 | 11831-11838 | 12200-12207 | 12569-12576 | 12938-12945 | 14045-14052 | 14414-14421 | 14783-14790 | 15152-15159 | 15521-15528 | 15890-15897 |
| 17 | mRNA Design c-4 | 11839-11846 | 12208-12215 | 12577-12584 | 12946-12953 | 14053-14060 | 14422-14429 | 14791-14798 | 15160-15167 | 15529-15536 | 15898-15905 |
| 18 | mRNA Design c-5 | 11847-11854 | 12216-12223 | 12585-12592 | 12954-12961 | 14061-14068 | 14430-14437 | 14799-14806 | 15168-15175 | 15537-15544 | 15906-15913 |
| 19 | mRNA Design d-1 | 11855-11862 | 12224-12231 | 12593-12600 | 12962-12969 | 14069-14076 | 14438-14445 | 14807-14814 | 15176-15183 | 15545-15552 | 15914-15921 |
| 20 | mRNA Design d-2 | 11863-11870 | 12232-12239 | 12601-12608 | 12970-12977 | 14077-14084 | 14446-14453 | 14815-14822 | 15184-15191 | 15553-15560 | 15922-15929 |
| 21 | mRNA Design d-3 | 11871-11878 | 12240-12247 | 12609-12616 | 12978-12985 | 14085-14092 | 14454-14461 | 14823-14830 | 15192-15199 | 15561-15568 | 15930-15937 |
| 22 | mRNA Design d-4 | 11879-11886 | 12248-12255 | 12617-12624 | 12986-12993 | 14093-14100 | 14462-14469 | 14831-14838 | 15200-15207 | 15569-15576 | 15938-15945 |
| 23 | mRNA Design d-5 | 11887-11894 | 12256-12263 | 12625-12632 | 12994-13001 | 14101-14108 | 14470-14477 | 14839-14846 | 15208-15215 | 15577-15584 | 15946-15953 |
| 24 | mRNA Design e-1 | 11895-11902 | 12264-12271 | 12633-12640 | 13002-13009 | 14109-14116 | 14478-14485 | 14847-14854 | 15216-15223 | 15585-15592 | 15954-15961 |
| 25 | mRNA Design e-2 | 11903-11910 | 12272-12279 | 12641-12648 | 13010-13017 | 14117-14124 | 14486-14493 | 14855-14862 | 15224-15231 | 15593-15600 | 15962-15969 |
| 26 | mRNA Design e-3 | 11911-11918 | 12280-12287 | 12649-12656 | 13018-13025 | 14125-14132 | 14494-14501 | 14863-14870 | 15232-15239 | 15601-15608 | 15970-15977 |

TABLE 5B-continued

Preferred mRNA constructs encoding RSV F (columns A-J), derived from HRSV(Memphis-37)

| 1 | | A | B | C | D | E | F | G | H | I | J |
|---|---|---|---|---|---|---|---|---|---|---|---|
| 27 | mRNA Design e-4 | 11919-11926 | 12288-12295 | 12657-12664 | 13026-13033 | 14133-14140 | 14502-14509 | 14871-14878 | 15240-15247 | 15609-15616 | 15978-15985 |
| 28 | mRNA Design e-5 | 11927-11934 | 12296-12303 | 12665-12672 | 13034-13041 | 14141-14148 | 14510-14517 | 14879-14886 | 15248-15255 | 15617-15624 | 15986-15993 |
| 29 | mRNA Design e-6 | 11935-11942 | 12304-12311 | 12673-12680 | 13042-13049 | 14149-14156 | 14518-14525 | 14887-14894 | 15256-15263 | 15625-15632 | 15994-16001 |
| 30 | mRNA Design f-1 | 11943-11950 | 12312-12319 | 12681-12688 | 13050-13057 | 14157-14164 | 14526-14533 | 14895-14902 | 15264-15271 | 15633-15640 | 16002-16009 |
| 31 | mRNA Design f-2 | 11951-11958 | 12320-12327 | 12689-12696 | 13058-13065 | 14165-14172 | 14534-14541 | 14903-14910 | 15272-15279 | 15641-15648 | 16010-16017 |
| 32 | mRNA Design f-3 | 11959-11966 | 12328-12335 | 12697-12704 | 13066-13073 | 14173-14180 | 14542-14549 | 14911-14918 | 15280-15287 | 15649-15656 | 16018-16025 |
| 33 | mRNA Design f-4 | 11967-11974 | 12336-12343 | 12705-12712 | 13074-13081 | 14181-14188 | 14550-14557 | 14919-14926 | 15288-15295 | 15657-15664 | 16026-16033 |
| 34 | mRNA Design f-5 | 11975-11982 | 12344-12351 | 12713-12720 | 13082-13089 | 14189-14196 | 14558-14565 | 14927-14934 | 15296-15303 | 15665-15672 | 16034-16041 |
| 35 | mRNA Design g-1 | 11983-11990 | 12352-12359 | 12721-12728 | 13090-13097 | 14197-14204 | 14566-14573 | 14935-14942 | 15304-15311 | 15673-15680 | 16042-16049 |
| 36 | mRNA Design g-2 | 11991-11998 | 12360-12367 | 12729-12736 | 13098-13105 | 14205-14212 | 14574-14581 | 14943-14950 | 15312-15319 | 15681-15688 | 16050-16057 |
| 37 | mRNA Design g-3 | 11999-12006 | 12368-12375 | 12737-12744 | 13106-13113 | 14213-14220 | 14582-14589 | 14951-14958 | 15320-15327 | 15689-15696 | 16058-16065 |
| 38 | mRNA Design g-4 | 12007-12014 | 12376-12383 | 12745-12752 | 13114-13121 | 14221-14228 | 14590-14597 | 14959-14966 | 15328-15335 | 15697-15704 | 16066-16073 |
| 39 | mRNA Design g-5 | 12015-12022 | 12384-12391 | 12753-12760 | 13122-13129 | 14229-14236 | 14598-14605 | 14967-14974 | 15336-15343 | 15705-15712 | 16074-16081 |
| 40 | mRNA Design h-1 | 12023-12030 | 12392-12399 | 12761-12768 | 13130-13137 | 14237-14244 | 14606-14613 | 14975-14982 | 15344-15351 | 15713-15720 | 16082-16089 |
| 41 | mRNA Design h-2 | 12031-12038 | 12400-12407 | 12769-12776 | 13138-13145 | 14245-14252 | 14614-14621 | 14983-14990 | 15352-15359 | 15721-15728 | 16090-16097 |
| 42 | mRNA Design h-3 | 12039-12046 | 12408-12415 | 12777-12784 | 13146-13153 | 14253-14260 | 14622-14629 | 14991-14998 | 15360-15367 | 15729-15736 | 16098-16105 |
| 43 | mRNA Design h-4 | 12047-12054 | 12416-12423 | 12785-12792 | 13154-13161 | 14261-14268 | 14630-14637 | 14999-15006 | 15368-15375 | 15737-15744 | 16106-16113 |
| 44 | mRNA Design h-5 | 12055-12062 | 12424-12431 | 12793-12800 | 13162-13169 | 14269-14276 | 14638-14645 | 15007-15014 | 15376-15383 | 15745-15752 | 16114-16121 |
| 45 | mRNA Design i-1 | 12063-12070 | 12432-12439 | 12801-12808 | 13170-13177 | 14277-14284 | 14646-14653 | 15015-15022 | 15384-15391 | 15753-15760 | 16122-16129 |
| 46 | mRNA Design i-2 | 12071-12086 | 12440-12455 | 12809-12824 | 13178-13193 | 14285-14300 | 14654-14669 | 15023-15038 | 15392-15407 | 15761-15776 | 16130-16145 |
| 47 | mRNA Design i-3 | 12087-12094 | 12456-12463 | 12825-12832 | 13194-13201 | 14301-14308 | 14670-14677 | 15039-15046 | 15408-15415 | 15777-15784 | 16146-16153 |

In Table 6A and 6B, the protein designs are indicated in row 1. Therein, Columns K to V represent specific suitable constructs of the invention derived from RSV Fusion (F) protein, wherein Column K provides suitable sequences for F_DSCav1_mut0, Column L provides suitable sequences for F-del_DSCav1_mut0, Column M provides suitable sequences for F_DSCav1_mut4, Column N provides suitable sequences for F-del_DSCav1_mut4, Column O provides suitable sequences for F_DSCav1_mut5, Column P provides suitable sequences for F-del_DSCav1_mut5, Column Q provides suitable sequences for F_DSCav1_mut6, Column R provides suitable sequences for F-del_DSCav1_mut6, Column S provides suitable sequences for F_DSCav1_mut7, Column T provides suitable sequences for F-del_DSCav1_mut7, Column U provides suitable sequences for F_DSCav1_mut8, Column V provides suitable sequences for F-del_DSCav1_mut8.

The protein designs are indicated in the first row (Columns K to V), the specific protein SEQ ID NOs as provided in the sequence listing are in row 2, "PRT". The SEQ ID NOs of corresponding coding sequences for each protein construct are provided in row 3, "cds" (compare with Table 4 for different cds optimizations). Further information e.g. regarding the type of codon modified coding sequence (opt1, opt2, opt3, opt4, opt5, opt6, opt11 etc.) is provided in the <223> identifier of the respective SEQ ID NO in the sequence listing and in Table 4. The SEQ ID NOs of corresponding mRNA constructs comprising said coding sequences and suitable 3'-UTRs and 5'-UTRs according to the invention are provided in each following row (mRNA designs "a-1" to "i-3" as specified herein). In Table 6A, mRNA sequences derived from HRSV(A2) are provided, in Table 6B mRNA sequences derived from HRSV(Memphis-37) are provided Further information e.g. regarding the type of coding sequence (wt, opt1, opt2, opt3, opt4, opt5, opt6, opt11 etc.) comprised in the mRNA constructs is provided in the <223> identifier of the respective SEQ ID NO in the sequence listing.

TABLE 6A

Preferred mRNA constructs encoding RSV F (column K-V), derived from HRSV(A2)

| | K | L | M | N | O | P | Q | R | S | T | U | V |
|---|---|---|---|---|---|---|---|---|---|---|---|---|
| PRT | 3850 | 4219 | 4588 | 4957 | 5326 | 5695 | 6064 | 6433 | 6802 | 7171 | 7540 | 7909 |
| cds | 3851-3858, 21367 | 4220-4227, 21368 | 4589-4596, 21375 | 4958-4965, 21376 | 5327-5334, 21377 | 5696-5703, 21378 | 6065-6072, 21379 | 6434-6441, 21380 | 6803-6810, 21381 | 7172-7179, 21382 | 7541-7548, 21383 | 7910-7917, 21384 |
| a-1 | 3859-3866, 21427-21429, 21573-21575 | 4228-4235, 21430-21432, 21576-21578 | 4597-4604, 21451-21453, 21597-21599 | 4966-4973, 21454-21456, 21600-21602 | 5335-5342, 21457-21459, 21603-21605 | 5704-5711, 21460-21462, 21606-21608 | 6073-6080, 21463-21465, 21609-21611 | 6442-6449, 21466-21468, 21612-21614 | 6811-6818, 21469-21471, 21615-21617 | 7180-7187, 21472-21474, 21618-21620 | 7549-7556, 21475-21477, 21621-21623 | 7918-7925, 21478-21480, 21624-21626 |
| a-2 | 3867-3874 | 4236-4243 | 4605-4612 | 4974-4981 | 5343-5350 | 5712-5719 | 6081-6088 | 6450-6457 | 6819-6826 | 7188-7195 | 7557-7564 | 7926-7933 |
| a-3 | 3875-3882 | 4244-4251 | 4613-4620 | 4982-4989 | 5351-5358 | 5720-5727 | 6089-6096 | 6458-6465 | 6827-6834 | 7196-7203 | 7565-7572 | 7934-7941 |
| a-4 | 3883-3890 | 4252-4259 | 4621-4628 | 4990-4997 | 5359-5366 | 5728-5735 | 6097-6104 | 6466-6473 | 6835-6842 | 7204-7211 | 7573-7580 | 7942-7949 |
| a-5 | 3891-3898 | 4260-4267 | 4629-4636 | 4998-5005 | 5367-5374 | 5736-5743 | 6105-6112 | 6474-6481 | 6843-6850 | 7212-7219 | 7581-7588 | 7950-7957 |
| b-1 | 3899-3906 | 4268-4275 | 4637-4644 | 5006-5013 | 5375-5382 | 5744-5751 | 6113-6120 | 6482-6489 | 6851-6858 | 7220-7227 | 7589-7596 | 7958-7965 |
| b-2 | 3907-3914 | 4276-4283 | 4645-4652 | 5014-5021 | 5383-5390 | 5752-5759 | 6121-6128 | 6490-6497 | 6859-6866 | 7228-7235 | 7597-7604 | 7966-7973 |
| b-3 | 3915-3922 | 4284-4291 | 4653-4660 | 5022-5029 | 5391-5398 | 5760-5767 | 6129-6136 | 6498-6505 | 6867-6874 | 7236-7243 | 7605-7612 | 7974-7981 |
| b-4 | 3923-3930 | 4292-4299 | 4661-4668 | 5030-5037 | 5399-5406 | 5768-5775 | 6137-6144 | 6506-6513 | 6875-6882 | 7244-7251 | 7613-7620 | 7982-7989 |
| b-5 | 3931-3938 | 4300-4307 | 4669-4676 | 5038-5045 | 5407-5414 | 5776-5783 | 6145-6152 | 6514-6521 | 6883-6890 | 7252-7259 | 7621-7628 | 7990-7997 |
| c-1 | 3939-3946 | 4308-4315 | 4677-4684 | 5046-5053 | 5415-5422 | 5784-5791 | 6153-6160 | 6522-6529 | 6891-6898 | 7260-7267 | 7629-7636 | 7998-8005 |
| c-2 | 3947-3954 | 4316-4323 | 4685-4692 | 5054-5061 | 5423-5430 | 5792-5799 | 6161-6168 | 6530-6537 | 6899-6906 | 7268-7275 | 7637-7644 | 8006-8013 |
| c-3 | 3955-3962 | 4324-4331 | 4693-4700 | 5062-5069 | 5431-5438 | 5800-5807 | 6169-6176 | 6538-6545 | 6907-6914 | 7276-7283 | 7645-7652 | 8014-8021 |
| c-4 | 3963-3970 | 4332-4339 | 4701-4708 | 5070-5077 | 5439-5446 | 5808-5815 | 6177-6184 | 6546-6553 | 6915-6922 | 7284-7291 | 7653-7660 | 8022-8029 |
| c-5 | 3971-3978 | 4340-4347 | 4709-4716 | 5078-5085 | 5447-5454 | 5816-5823 | 6185-6192 | 6554-6561 | 6923-6930 | 7292-7299 | 7661-7668 | 8030-8037 |
| d-1 | 3979-3986 | 4348-4355 | 4717-4724 | 5086-5093 | 5455-5462 | 5824-5831 | 6193-6200 | 6562-6569 | 6931-6938 | 7300-7307 | 7669-7676 | 8038-8045 |
| d-2 | 3987-3994 | 4356-4363 | 4725-4732 | 5094-5101 | 5463-5470 | 5832-5839 | 6201-6208 | 6570-6577 | 6939-6946 | 7308-7315 | 7677-7684 | 8046-8053 |
| d-3 | 3995-4002 | 4364-4371 | 4733-4740 | 5102-5109 | 5471-5478 | 5840-5847 | 6209-6216 | 6578-6585 | 6947-6954 | 7316-7323 | 7685-7692 | 8054-8061 |
| d-4 | 4003-4010 | 4372-4379 | 4741-4748 | 5110-5117 | 5479-5486 | 5848-5855 | 6217-6224 | 6586-6593 | 6955-6962 | 7324-7331 | 7693-7700 | 8062-8069 |
| d-5 | 4011-4018 | 4380-4387 | 4749-4756 | 5118-5125 | 5487-5494 | 5856-5863 | 6225-6232 | 6594-6601 | 6963-6970 | 7332-7339 | 7701-7708 | 8070-8077 |
| e-1 | 4019-4026 | 4388-4395 | 4757-4764 | 5126-5133 | 5495-5502 | 5864-5871 | 6233-6240 | 6602-6609 | 6971-6978 | 7340-7347 | 7709-7716 | 8078-8085 |
| e-2 | 4027-4034 | 4396-4403 | 4765-4772 | 5134-5141 | 5503-5510 | 5872-5879 | 6241-6248 | 6610-6617 | 6979-6986 | 7348-7355 | 7717-7724 | 8086-8093 |
| e-3 | 4035-4042 | 4404-4411 | 4773-4780 | 5142-5149 | 5511-5518 | 5880-5887 | 6249-6256 | 6618-6625 | 6987-6994 | 7356-7363 | 7725-7732 | 8094-8101 |
| e-4 | 4043-4050 | 4412-4419 | 4781-4788 | 5150-5157 | 5519-5526 | 5888-5895 | 6257-6264 | 6626-6633 | 6995-7002 | 7364-7371 | 7733-7740 | 8102-8109 |
| e-5 | 4051-4058 | 4420-4427 | 4789-4796 | 5158-5165 | 5527-5534 | 5896-5903 | 6265-6272 | 6634-6641 | 7003-7010 | 7372-7379 | 7741-7748 | 8110-8117 |
| e-6 | 4059-4066 | 4428-4435 | 4797-4804 | 5166-5173 | 5535-5542 | 5904-5911 | 6273-6280 | 6642-6649 | 7011-7018 | 7380-7387 | 7749-7756 | 8118-8125 |
| f-1 | 4067-4074 | 4436-4443 | 4805-4812 | 5174-5181 | 5543-5550 | 5912-5919 | 6281-6288 | 6650-6657 | 7019-7026 | 7388-7395 | 7757-7764 | 8126-8133 |
| f-2 | 4075-4082 | 4444-4451 | 4813-4820 | 5182-5189 | 5551-5558 | 5920-5927 | 6289-6296 | 6658-6665 | 7027-7034 | 7396-7403 | 7765-7772 | 8134-8141 |
| f-3 | 4083-4090 | 4452-4459 | 4821-4828 | 5190-5197 | 5559-5566 | 5928-5935 | 6297-6304 | 6666-6673 | 7035-7042 | 7404-7411 | 7773-7780 | 8142-8149 |
| f-4 | 4091-4098 | 4460-4467 | 4829-4836 | 5198-5205 | 5567-5574 | 5936-5943 | 6305-6312 | 6674-6681 | 7043-7050 | 7412-7419 | 7781-7788 | 8150-8157 |
| f-5 | 4099-4106 | 4468-4475 | 4837-4844 | 5206-5213 | 5575-5582 | 5944-5951 | 6313-6320 | 6682-6689 | 7051-7058 | 7420-7427 | 7789-7796 | 8158-8165 |
| g-1 | 4107-4114 | 4476-4483 | 4845-4852 | 5214-5221 | 5583-5590 | 5952-5959 | 6321-6328 | 6690-6697 | 7059-7066 | 7428-7435 | 7797-7804 | 8166-8173 |
| g-2 | 4115-4122 | 4484-4491 | 4853-4860 | 5222-5229 | 5591-5598 | 5960-5967 | 6329-6336 | 6698-6705 | 7067-7074 | 7436-7443 | 7805-7812 | 8174-8181 |
| g-3 | 4123-4130 | 4492-4499 | 4861-4868 | 5230-5237 | 5599-5606 | 5968-5975 | 6337-6344 | 6706-6713 | 7075-7082 | 7444-7451 | 7813-7820 | 8182-8189 |

TABLE 6A-continued

Preferred mRNA constructs encoding RSV F (column K-V), derived from HRSV(A2)

| | K | L | M | N | O | P | Q | R | S | T | U | V |
|---|---|---|---|---|---|---|---|---|---|---|---|---|
| g-4 | 4131-4138 | 4500-4507 | 4869-4876 | 5238-5245 | 5607-5614 | 5976-5983 | 6345-6352 | 6714-6721 | 7083-7090 | 7452-7459 | 7821-7828 | 8190-8197 |
| g-5 | 4139-4146 | 4508-4515 | 4877-4884 | 5246-5253 | 5615-5622 | 5984-5991 | 6353-6360 | 6722-6729 | 7091-7098 | 7460-7467 | 7829-7836 | 8198-8205 |
| h-1 | 4147-4154 | 4516-4523 | 4885-4892 | 5254-5261 | 5623-5630 | 5992-5999 | 6361-6368 | 6730-6737 | 7099-7106 | 7468-7475 | 7837-7844 | 8206-8213 |
| h-2 | 4155-4162 | 4524-4531 | 4893-4900 | 5262-5269 | 5631-5638 | 6000-6007 | 6369-6376 | 6738-6745 | 7107-7114 | 7476-7483 | 7845-7852 | 8214-8221 |
| h-3 | 4163-4170 | 4532-4539 | 4901-4908 | 5270-5277 | 5639-5646 | 6008-6015 | 6377-6384 | 6746-6753 | 7115-7122 | 7484-7491 | 7853-7860 | 8222-8229 |
| h-4 | 4171-4178 | 4540-4547 | 4909-4916 | 5278-5285 | 5647-5654 | 6016-6023 | 6385-6392 | 6754-6761 | 7123-7130 | 7492-7499 | 7861-7868 | 8230-8237 |
| h-5 | 4179-4186 | 4548-4555 | 4917-4924 | 5286-5293 | 5655-5662 | 6024-6031 | 6393-6400 | 6762-6769 | 7131-7138 | 7500-7507 | 7869-7876 | 8238-8245 |
| i-1 | 4187-4194 | 4556-4563 | 4925-4932 | 5294-5301 | 5663-5670 | 6032-6039 | 6401-6408 | 6770-6777 | 7139-7146 | 7508-7515 | 7877-7884 | 8246-8253 |
| i-2 | 4195-4210 | 4564-4579 | 4933-4948 | 5302-5317 | 5671-5686 | 6040-6055 | 6409-6424 | 6778-6793 | 7147-7162 | 7516-7531 | 7885-7900 | 8254-8269 |
| i-3 | 4211-4218 | 4580-4587 | 4949-4956 | 5318-5325 | 5687-5694 | 6056-6063 | 6425-6432 | 6794-6801 | 7163-7170 | 7532-7539 | 7901-7908 | 8270-8277 |

TABLE 6B

Preferred mRNA constructs encoding RSV F (column K-V), derived from HRSV(Memphis-37)

| | K | L | M | N | O | P | Q | R | S | T | U | V |
|---|---|---|---|---|---|---|---|---|---|---|---|---|
| PRT | 13202 | 13571 | 16154 | 16523 | 16892 | 17261 | 17630 | 17999 | 18368 | 18737 | 19106 | 19475 |
| cds | 13203-13210, 21393 | 13572-13579, 21394 | 16155-16162, 21401 | 16524-16531, 21402 | 16893-16900, 21403 | 17262-17269, 21404 | 17631-17638, 21405 | 18000-18007, 21406 | 18369-18376, 21407 | 18738-18745, 21408 | 19107-19114, 21409 | 19476-19483, 21410 |
| a-1 | 13211-13218, 21499-21501, 21645-21647 | 13580-13587, 21502-21504, 21648-21650 | 16163-16170, 21523-21525, 21669-21671 | 16532-16539, 21526-21528, 21672-21674 | 16901-16908, 21529-21531, 21675-21677 | 17270-17277, 21532-21534, 21678-21680 | 17639-17646, 21535-21537, 21681-21683 | 18008-18015, 21538-21540, 21684-21686 | 18377-18384, 21541-21543, 21687-21689 | 18746-18753, 21544-21546, 21690-21692 | 19115-19122, 21547-21549, 21693-21695 | 19484-19491, 21550-21552, 21696-21698 |
| a-2 | 13219-13226 | 13588-13595 | 16171-16178 | 16540-16547 | 16909-16916 | 17278-17285 | 17647-17654 | 18016-18023 | 18385-18392 | 18754-18761 | 19123-19130 | 19492-19499 |
| a-3 | 13227-13234 | 13596-13603 | 16179-16186 | 16548-16555 | 16917-16924 | 17286-17293 | 17655-17662 | 18024-18031 | 18393-18400 | 18762-18769 | 19131-19138 | 19500-19507 |
| a-4 | 13235-13242 | 13604-13611 | 16187-16194 | 16556-16563 | 16925-16932 | 17294-17301 | 17663-17670 | 18032-18039 | 18401-18408 | 18770-18777 | 19139-19146 | 19508-19515 |
| a-5 | 13243-13250 | 13612-13619 | 16195-16202 | 16564-16571 | 16933-16940 | 17302-17309 | 17671-17678 | 18040-18047 | 18409-18416 | 18778-18785 | 19147-19154 | 19516-19523 |
| b-1 | 13251-13258 | 13620-13627 | 16203-16210 | 16572-16579 | 16941-16948 | 17310-17317 | 17679-17686 | 18048-18055 | 18417-18424 | 18786-18793 | 19155-19162 | 19524-19531 |
| b-2 | 13259-13266 | 13628-13635 | 16211-16218 | 16580-16587 | 16949-16956 | 17318-17325 | 17687-17694 | 18056-18063 | 18425-18432 | 18794-18801 | 19163-19170 | 19532-19539 |
| b-3 | 13267-13274 | 13636-13643 | 16219-16226 | 16588-16595 | 16957-16964 | 17326-17333 | 17695-17702 | 18064-18071 | 18433-18440 | 18802-18809 | 19171-19178 | 19540-19547 |
| b-4 | 13275-13282 | 13644-13651 | 16227-16234 | 16596-16603 | 16965-16972 | 17334-17341 | 17703-17710 | 18072-18079 | 18441-18448 | 18810-18817 | 19179-19186 | 19548-19555 |
| b-5 | 13283-13290 | 13652-13659 | 16235-16242 | 16604-16611 | 16973-16980 | 17342-17349 | 17711-17718 | 18080-18087 | 18449-18456 | 18818-18825 | 19187-19194 | 19556-19563 |
| c-1 | 13291-13298 | 13660-13667 | 16243-16250 | 16612-16619 | 16981-16988 | 17350-17357 | 17719-17726 | 18088-18095 | 18457-18464 | 18826-18833 | 19195-19202 | 19564-19571 |
| c-2 | 13299-13306 | 13668-13675 | 16251-16258 | 16620-16627 | 16989-16996 | 17358-17365 | 17727-17734 | 18096-18103 | 18465-18472 | 18834-18841 | 19203-19210 | 19572-19579 |
| c-3 | 13307-13314 | 13676-13683 | 16259-16266 | 16628-16635 | 16997-17004 | 17366-17373 | 17735-17742 | 18104-18111 | 18473-18480 | 18842-18849 | 19211-19218 | 19580-19587 |
| c-4 | 13315-13322 | 13684-13691 | 16267-16274 | 16636-16643 | 17005-17012 | 17374-17381 | 17743-17750 | 18112-18119 | 18481-18488 | 18850-18857 | 19219-19226 | 19588-19595 |
| c-5 | 13323-13330 | 13692-13699 | 16275-16282 | 16644-16651 | 17013-17020 | 17382-17389 | 17751-17758 | 18120-18127 | 18489-18496 | 18858-18865 | 19227-19234 | 19596-19603 |
| d-1 | 13331-13338 | 13700-13707 | 16283-16290 | 16652-16659 | 17021-17028 | 17390-17397 | 17759-17766 | 18128-18135 | 18497-18504 | 18866-18873 | 19235-19242 | 19604-19611 |
| d-2 | 13339-13346 | 13708-13715 | 16291-16298 | 16660-16667 | 17029-17036 | 17398-17405 | 17767-17774 | 18136-18143 | 18505-18512 | 18874-18881 | 19243-19250 | 19612-19619 |
| d-3 | 13347-13354 | 13716-13723 | 16299-16306 | 16668-16675 | 17037-17044 | 17406-17413 | 17775-17782 | 18144-18151 | 18513-18520 | 18882-18889 | 19251-19258 | 19620-19627 |
| d-4 | 13355-13362 | 13724-13731 | 16307-16314 | 16676-16683 | 17045-17052 | 17414-17421 | 17783-17790 | 18152-18159 | 18521-18528 | 18890-18897 | 19259-19266 | 19628-19635 |

TABLE 6B-continued

Preferred mRNA constructs encoding RSV F (column K-V), derived from HRSV(Memphis-37)

| | K | L | M | N | O | P | Q | R | S | T | U | V |
|---|---|---|---|---|---|---|---|---|---|---|---|---|
| d-5 | 13363-13370 | 13732-13739 | 16315-16322 | 16684-16691 | 17053-17060 | 17422-17429 | 17791-17798 | 18160-18167 | 18529-18536 | 18898-18905 | 19267-19274 | 19636-19643 |
| e-1 | 13371-13378 | 13740-13747 | 16323-16330 | 16692-16699 | 17061-17068 | 17430-17437 | 17799-17806 | 18168-18175 | 18537-18544 | 18906-18913 | 19275-19282 | 19644-19651 |
| e-2 | 13379-13386 | 13748-13755 | 16331-16338 | 16700-16707 | 17069-17076 | 17438-17445 | 17807-17814 | 18176-18183 | 18545-18552 | 18914-18921 | 19283-19290 | 19652-19659 |
| e-3 | 13387-13394 | 13756-13763 | 16339-16346 | 16708-16715 | 17077-17084 | 17446-17453 | 17815-17822 | 18184-18191 | 18553-18560 | 18922-18929 | 19291-19298 | 19660-19667 |
| e-4 | 13395-13402 | 13764-13771 | 16347-16354 | 16716-16723 | 17085-17092 | 17454-17461 | 17823-17830 | 18192-18199 | 18561-18568 | 18930-18937 | 19299-19306 | 19668-19675 |
| e-5 | 13403-13410 | 13772-13779 | 16355-16362 | 16724-16731 | 17093-17100 | 17462-17469 | 17831-17838 | 18200-18207 | 18569-18576 | 18938-18945 | 19307-19314 | 19676-19683 |
| e-6 | 13411-13418 | 13780-13787 | 16363-16370 | 16732-16739 | 17101-17108 | 17470-17477 | 17839-17846 | 18208-18215 | 18577-18584 | 18946-18953 | 19315-19322 | 19684-19691 |
| f-1 | 13419-13426 | 13788-13795 | 16371-16378 | 16740-16747 | 17109-17116 | 17478-17485 | 17847-17854 | 18216-18223 | 18585-18592 | 18954-18961 | 19323-19330 | 19692-19699 |
| f-2 | 13427-13434 | 13796-13803 | 16379-16386 | 16748-16755 | 17117-17124 | 17486-17493 | 17855-17862 | 18224-18231 | 18593-18600 | 18962-18969 | 19331-19338 | 19700-19707 |
| f-3 | 13435-13442 | 13804-13811 | 16387-16394 | 16756-16763 | 17125-17132 | 17494-17501 | 17863-17870 | 18232-18239 | 18601-18608 | 18970-18977 | 19339-19346 | 19708-19715 |
| f-4 | 13443-13450 | 13812-13819 | 16395-16402 | 16764-16771 | 17133-17140 | 17502-17509 | 17871-17878 | 18240-18247 | 18609-18616 | 18978-18985 | 19347-19354 | 19716-19723 |
| f-5 | 13451-13458 | 13820-13827 | 16403-16410 | 16772-16779 | 17141-17148 | 17510-17517 | 17879-17886 | 18248-18255 | 18617-18624 | 18986-18993 | 19355-19362 | 19724-19731 |
| g-1 | 13459-13466 | 13828-13835 | 16411-16418 | 16780-16787 | 17149-17156 | 17518-17525 | 17887-17894 | 18256-18263 | 18625-18632 | 18994-19001 | 19363-19370 | 19732-19739 |
| g-2 | 13467-13474 | 13836-13843 | 16419-16426 | 16788-16795 | 17157-17164 | 17526-17533 | 17895-17902 | 18264-18271 | 18633-18640 | 19002-19009 | 19371-19378 | 19740-19747 |
| g-3 | 13475-13482 | 13844-13851 | 16427-16434 | 16796-16803 | 17165-17172 | 17534-17541 | 17903-17910 | 18272-18279 | 18641-18648 | 19010-19017 | 19379-19386 | 19748-19755 |
| g-4 | 13483-13490 | 13852-13859 | 16435-16442 | 16804-16811 | 17173-17180 | 17542-17549 | 17911-17918 | 18280-18287 | 18649-18656 | 19018-19025 | 19387-19394 | 19756-19763 |
| g-5 | 13491-13498 | 13860-13867 | 16443-16450 | 16812-16819 | 17181-17188 | 17550-17557 | 17919-17926 | 18288-18295 | 18657-18664 | 19026-19033 | 19395-19402 | 19764-19771 |
| h-1 | 13499-13506 | 13868-13875 | 16451-16458 | 16820-16827 | 17189-17196 | 17558-17565 | 17927-17934 | 18296-18303 | 18665-18672 | 19034-19041 | 19403-19410 | 19772-19779 |
| h-2 | 13507-13514 | 13876-13883 | 16459-16466 | 16828-16835 | 17197-17204 | 17566-17573 | 17935-17942 | 18304-18311 | 18673-18680 | 19042-19049 | 19411-19418 | 19780-19787 |
| h-3 | 13515-13522 | 13884-13891 | 16467-16474 | 16836-16843 | 17205-17212 | 17574-17581 | 17943-17950 | 18312-18319 | 18681-18688 | 19050-19057 | 19419-19426 | 19788-19795 |
| h-4 | 13523-13530 | 13892-13899 | 16475-16482 | 16844-16851 | 17213-17220 | 17582-17589 | 17951-17958 | 18320-18327 | 18689-18696 | 19058-19065 | 19427-19434 | 19796-19803 |
| h-5 | 13531-13538 | 13900-13907 | 16483-16490 | 16852-16859 | 17221-17228 | 17590-17597 | 17959-17966 | 18328-18335 | 18697-18704 | 19066-19073 | 19435-19442 | 19804-19811 |
| i-1 | 13539-13546 | 13908-13915 | 16491-16498 | 16860-16867 | 17229-17236 | 17598-17605 | 17967-17974 | 18336-18343 | 18705-18712 | 19074-19081 | 19443-19450 | 19812-19819 |
| i-2 | 13547-13562 | 13916-13931 | 16499-16514 | 16868-16883 | 17237-17252 | 17606-17621 | 17975-17990 | 18344-18359 | 18713-18728 | 19082-19097 | 19451-19466 | 19820-19835 |
| i-3 | 13563-13570 | 13932-13939 | 16515-16522 | 16884-16891 | 17253-17260 | 17622-17629 | 17991-17998 | 18360-18367 | 18729-18736 | 19098-19105 | 19467-19474 | 19836-19843 |

In preferred embodiments, the artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of Seq ID NOs: 78-482, 493-897, 907-1266, 1276-1635, 1645-2004, 2014-2373, 2383-2742, 2752-3111, 3121-3480, 3490-3849, 3859-4218, 4228-4587, 4597-4956, 4966-5325, 5335-5694, 5704-6063, 6073-6432, 6442-6801, 6811-7170, 7180-7539, 7549-7908, 7918-8277, 8278, 21415-21480, 21561-21626, 11735-12094, 12104-12463, 12473-12832, 12842-13201, 13949-14308, 14318-14677, 14687-15046, 15056-15415, 15425-15784, 15794-16153, 13211-13570, 13580-13939, 16163-16522, 16532-16891, 16901-17260, 17270-17629, 17639-17998, 18008-18367, 18377-18736, 18746-19105, 19115-19474, 19484-19843, 21489-21552, 21635-21698 or a fragment or variant of any of these sequences, wherein, optionally, at least one or more than one, or wherein all uracil nucleotides are replaced by pseudouridine (ψ) nucleotides or N1-methylpseudouridine (m1ψ) nucleotides.

In preferred embodiments, the artificial RNA comprises (a) at least one heterologous 5' untranslated region (5'-UTR) and/or at least one heterologous 3' untranslated region (3'-UTR) and
  (b) at least one coding sequence operably linked to said 3'-UTR and/or 5'-UTR encoding at least one antigenic peptide or protein derived from a RSV F or a fragment or variant thereof, wherein
    said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 78-482, 11735-12094, 21415-21417, 21561-21563, 21489, 21490, 21635, 21636 (encoding F0) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 493-897, 12104-12463, 21418-21420, 21564-21566, 21491, 21492, 21637, 21638 (encoding F-del) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 907-1266, 12473-12832, 21421-21423, 21567-21569, 21493-21495, 21639-21641 (encoding F0_DSCav1) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 1276-1635, 8278, 12842-13201, 21424-21426, 21570-21572, 21496-21498, 21642-21644 (encoding F-del_DSCav1) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 1645-2004, 13949-14308, 21433-21435, 21579-21581, 21505-21507, 21651-21653 (encoding F_DSCav1_mut1) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 2014-2373, 14318-14677, 21436-21438, 21582-21584, 21508-21510, 21654-21656 (encoding F-del_DSCav1_mut1) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 2383-2742, 14687-15046, 21439-21441, 21585-21587, 21511-21513, 21657-21659 (encoding F_DSCav1_mut2) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 2752-3111, 15056-15415, 21442-21444, 21588-21590, 21514-21516, 21660-21662 (encoding F-del_DSCav1_mut2) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 3121-3480, 15425-15784, 21445-21447, 21591-21593, 21517-21519, 21663-21665 (encoding F_DSCav1_mut3) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 3490-3849, 15794-16153, 21448-21450, 21594-21596, 21520-21522, 21666-21668 (encoding F-del_DSCav1_mut3) or a fragment or variant of any of these sequences.

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 3859-4218, 13211-13570, 21427-21429, 21573-21575, 21499-21501, 21645-21647 (encoding F_DSCav1_mut0) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 4228-4587, 13580-13939, 21430-21432, 21576-21578, 21502-21504, 21648-21650 (encoding F-del_DSCav1_mut0) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 4597-4956, 16163-16522, 21451-21453, 21597-21599, 21523-21525, 21669-21671 (encoding F_DSCav1_mut4) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 4966-5325, 16532-16891, 21454-21456, 21600-21602, 21526-21528, 21672-21674 (encoding F-del_DSCav1_mut4) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 5335-5694, 16901-17260, 21457-21459, 21603-21605, 21529-21531, 21675-21677 (encoding F_DSCav1_mut5) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 5704-6063, 17270-17629, 21460-21462, 21606-21608, 21532-21534, 21678-

21680 (encoding F-del_DSCav1_mut5) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 6073-6432, 17639-17998, 21463-21465, 21609-21611, 21535-21537, 21681-21683 (encoding F_DSCav1_mut6) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 6442-6801, 18008-18367, 21466-21468, 21612-21614, 21538-21540, 21684-21686 (encoding F-del_DSCav1_mut6) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 6811-7170, 18377-18736, 21469-21471, 21615-21617, 21541-21543, 21687-21689 (encoding F_DSCav1_mut7) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 7180-7539, 18746-19105, 21472-21474, 21618-21620, 21544-21546, 21690-21692 (encoding F-del_DSCav1_mut7) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 7549-7908, 19115-19474, 21475-21477, 21621-21623, 21547-21549, 21693-21695 (encoding F_DSCav1_mut8) or a fragment or variant of any of these sequences;

said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 7918-8277, 19484-19843, 21478-21480, 21624-21626, 21550-21552, 21696-21698 (encoding F-del_DSCav1_mut8) or a fragment or variant of any of these sequences, and wherein, optionally, at least one or more than one, or wherein all uracil nucleotides are replaced by pseudouridine (ψ) nucleotides or N1-methylpseudouridine (m1ψ) nucleotides.

In particularly preferred embodiments, the artificial RNA comprises (a) at least one heterologous 5' untranslated region (5'-UTR) and/or at least one heterologous 3' untranslated region (3'-UTR) and (b) at least one coding sequence operably linked to said 3'-UTR and/or 5'-UTR encoding at least one antigenic peptide or protein derived from a RSV F or a fragment or variant thereof, wherein said artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 5704-6063, 17270-17629, 21460-21462, 21606-21608, 21532-21534, 21678-21680 (encoding F-del_DSCav1_mut5) or a fragment or variant of any of these sequences.

As outlined throughout the specification, additional information regarding suitable amino acid sequences or nucleic acid sequences (coding sequences, mRNA sequences) may also be derived from the sequence listing, in particular from the details provided therein under identifier <223> as explained in the following.

For example, the numeric identifier <223> in the sequence listing of SEQ ID NO: 68 reads as follows: "derived and/or modified protein sequence (artificial) from HRSV(A2)_F0". It has to be noted that throughout the sequence listing, information provided under numeric identifier <223> follows the same structure: "<SEQUENCE_DESCRIPTOR> from <CONSTRUCT_IDENTIFIER>". The <SEQUENCE_DESCRIPTOR> relates to the type of sequence (e.g., "derived and/or modified protein sequence", "derived and/or modified CDS" "mRNA product Design a-1 comprising derived and/or modified sequence", or "mRNA product Design b-4 comprising derived and/or modified sequence", or "mRNA product Design c-5 comprising derived and/or modified sequence", or "mRNA product Design g-4 comprising derived and/or modified sequence" etc.) and whether the sequence comprises or consists of a wild type sequence ("wt") or whether the sequence comprises or consists of a sequence-optimized sequence (e.g. "opt1", "opt2", "opt3", "opt4", "opt5", "opt6", "opt11"; sequence optimizations are described in further detail below). For example, the <SEQUENCE_DESCRIPTOR> provided under numeric identifier <223> of SEQ ID NO: 68 reads as follows: "derived and/or modified protein sequence (artificial)". The <CONSTRUCT_IDENTIFIER> provided under numeric identifier <223> has the following structures: ("organism_construct name", or "organism_accession number_construct name") and is intended to help the person skilled in the art to explicitly derive suitable nucleic acid sequences (e.g., RNA, mRNA) encoding the same RSV protein according to the invention. For example, the <CONSTRUCT_IDENTIFIER> provided under numeric identifier <223> of SEQ ID NO: 68 reads as follows: "HRSV(A2)_F0". In that example, the respective protein sequence is derived from "HRSV (A2)" (organism), wherein the protein comprises the structural elements "F0" (construct name, full-length F). If the skilled person uses the construct identifier of SEQ ID NO: 68, namely "HRSV(A2)_F0", said person easily arrives at a list of suitable nucleic acid coding sequences, e.g. RNA coding sequences and mRNA sequences that can easily be retrieve from the sequence listing of the present invention.

Composition:

A second aspect relates to a composition comprising at least one artificial RNA of the first aspect.

In a preferred embodiment of the second aspect, the composition comprises at least one artificial RNA of the first aspect and, optionally, at least one pharmaceutically acceptable carrier.

The term "pharmaceutically acceptable carrier" as used herein preferably includes the liquid or non-liquid basis of the composition. If the composition is provided in liquid form, the carrier will preferably be water, typically pyrogen-free water; isotonic saline or buffered (aqueous) solutions, e.g. phosphate, citrate etc. buffered solutions. Water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer.

In embodiments, the composition as defined herein may comprise a plurality or at least more than one of the artificial RNAs as defined in the context of the first aspect or the second aspect of the invention.

In embodiments, the at least one RNA comprised in the composition is a bi- or multicistronic nucleic acid, particularly a bi- or multicistronic nucleic acid as defined herein, which encodes the at least two, three, four, five, six, seven, eight, nine, ten, eleven or twelve distinct antigenic peptides or protein derived from the same RSV and/or a different RSV.

In embodiment, the composition may comprise at least 2, 3, 4, 5, 6, 7, 8, 9, 10 or even more different artificial RNAs as defined in the context of the first aspect of the invention each encoding at least one antigenic peptide or protein derived from genetically the same RSV or a fragment or variant thereof. The terms "same" or "same RSV" as used in the context of a virus, e.g. "same virus", have to be understood as genetically the same. Particularly, said (genetically) same virus expresses the same proteins or peptides, wherein all proteins or peptides have the same amino acid sequence. Particularly, said (genetically) same RSV expresses essentially the same proteins, peptides or polyproteins, wherein these protein, peptide or polyproteins preferably do not differ in their amino acid sequence(s). A non-limiting list of exemplary RSV viruses is provided in List 1.

In embodiments, the composition comprises at least 2, 3, 4, 5, 6, 7, 8, 9, 10 or even more different RNAs as defined in the context of the first aspect of the invention each encoding at least one peptide or protein derived from a genetically different RSV or a fragment or variant thereof. The terms "different" or "different RSV" as used throughout the present specification in the context of a virus, e.g. "different" virus, has to be understood as the difference between at least two respective viruses, wherein the difference is manifested on the RNA genome of the respective different virus. Particularly, said (genetically) different RSV expresses at least one different protein, peptide or polyprotein, wherein the at least one different protein, peptide or polyprotein preferably differs in at least one amino acid.

In other embodiments, the composition comprises at least 1, 2, 3, 4, 5, 6, 7, 8, 9, 10 or even more further RNA constructs encoding RSV antigens selected from glycoprotein G, short hydrophobic protein SH, matrix protein M, nucleoprotein N, large polymerase L, M2-1 protein, M2-2 protein, phosphoprotein P, non-structural protein NS1 or non-structural protein NS2, or any combination thereof.

For the production of a composition comprising at least 1, 2, 3, 4, 5, 6, 7, 8, 9, 10 further RNA constructs encoding RSV, methods as disclosed in the PCT application PCT/EP2016/082487 or in published patent application WO2017/1090134A1 are preferably used and adapted accordingly.

In preferred embodiments, the composition of the second aspect comprises at least one artificial RNA of the first aspect and at least one further artificial RNA comprising at least one coding sequence encoding at least one antigenic peptide or protein derived from RSV selected from matrix protein M, nucleoprotein N, M2-1 protein, and/or phosphoprotein P or combinations thereof. The addition of a further artificial RNA comprising at least one coding sequence encoding at least one antigenic peptide or protein derived from RSV M, N, M2-1, and/or phosphoprotein P (or combinations thereof) is particularly advantageous to e.g. promote a T-cell immune response.

Notably, embodiments relating to the artificial RNA of the first aspect may likewise be read on and be understood as suitable embodiments of the at least one further artificial RNA of the second aspect (e.g., embodiments relating to UTR combinations, cds optimizations, histone stem loop, PolyA, PolyC, cap structure, mRNA structure, mRNA production and mRNA purification etc.).

Accordingly, the composition of the second aspect may suitably comprise at least one artificial RNA of the first aspect encoding RSF F and at least one further artificial RNA comprising at least one coding sequence encoding at least one antigenic peptide or protein derived from RSV matrix protein M.

Alternatively, the composition of the second aspect may suitably comprise at least one artificial RNA of the first aspect encoding RSF F and at least one further artificial RNA comprising at least one coding sequence encoding at least one antigenic peptide or protein derived from RSV N.

Alternatively, the composition of the second aspect may suitably comprise at least one artificial RNA of the first aspect encoding RSF F and at least one further artificial RNA comprising at least one coding sequence encoding at least one antigenic peptide or protein derived from RSV M2-1.

Alternatively, the composition of the second aspect may suitably comprise at least one artificial RNA of the first aspect encoding RSF F and at least one further artificial RNA comprising at least one coding sequence encoding at least one antigenic peptide or protein derived from RSV P.

In preferred embodiments, the composition of the second aspect comprises two further artificial RNA species each comprising at least one coding sequence encoding at least one antigenic peptide or protein derived from RSV selected from matrix protein M, nucleoprotein N, M2-1, and phosphoprotein P.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV M, and at least one further artificial RNA comprising at least one coding sequence encoding at least one antigenic peptide or protein derived from RSV N.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV N, and at least one further artificial RNA comprising at least one coding sequence encoding at least one antigenic peptide or protein derived from RSV M2-1.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV P, and at least one further artificial RNA comprising at least one coding sequence encoding at least one antigenic peptide or protein derived from RSV M2-1.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV P, and at least one further artificial RNA comprising at least one coding sequence encoding at least one antigenic peptide or protein derived from RSV N.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV M, and at least one further artificial RNA comprising at least one coding sequence encoding at least one antigenic peptide or protein derived from RSV M2-1.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV M, and at least one further artificial RNA comprising at least one coding sequence encoding at least one antigenic peptide or protein derived from RSV P.

In preferred embodiments, the composition of the second aspect comprises three further artificial RNA species each comprising at comprising three further artificial RNA species each comprising at least one coding sequence encoding at least one antigenic peptide or protein derived from RSV selected from matrix protein M, nucleoprotein N, M2-1, and phosphoprotein P.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV M, at least one further artificial RNA comprising at least one coding sequence encoding at least one antigenic peptide or protein derived from RSV N, and at least one further artificial RNA comprising at least one coding sequence encoding at least one antigenic peptide or protein derived from RSV P.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV M2-1, at least one further artificial RNA comprising at least one coding sequence encoding at least one antigenic peptide or protein derived from RSV N, and at least one further artificial RNA comprising at least one coding sequence encoding at least one antigenic peptide or protein derived from RSV P.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV M2-1, at least one further artificial RNA comprising at least one coding sequence encoding at least one antigenic peptide or protein derived from RSV M, and at least one further artificial RNA comprising at least one coding sequence encoding at least one antigenic peptide or protein derived from RSV P.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV M2-1, at least one further artificial RNA comprising at least one coding sequence encoding at least one antigenic peptide or protein derived from RSV M, and at least one further artificial RNA comprising at least one coding sequence encoding at least one antigenic peptide or protein derived from RSV N.

Accordingly, the composition of the second aspect may suitably comprise at least one artificial RNA of the first aspect encoding RSF F and at least one further artificial RNA comprising at least one coding sequence encoding at least one antigenic peptide or protein derived from RSV M2-1.

In preferred embodiments, the composition of the second aspect comprises four further artificial RNA species each comprising at comprising three further artificial RNA species each comprising at least one coding sequence encoding at least one antigenic peptide or protein derived from RSV selected from matrix protein M, nucleoprotein N, M2-1, and phosphoprotein P.

Accordingly, the composition of the second aspect may suitably comprise at least one artificial RNA of the first aspect encoding RSF F, at least one further artificial RNA comprising at least one coding sequence encoding at least one antigenic peptide or protein derived from RSV M, at least one further artificial RNA comprising at least one coding sequence encoding at least one antigenic peptide or protein derived from RSV N, at least one further artificial RNA comprising at least one coding sequence encoding at least one antigenic peptide or protein derived from RSV P, and at least one further artificial RNA comprising at least one coding sequence encoding at least one antigenic peptide or protein derived from RSV M2-1.

In preferred embodiments of the second aspect, the coding sequence of the further artificial RNA encodes at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 9684, 10053-10133, 10134, 10503-10636, 10637, 11006-11182, 11183, 11552-11725, 19844, 20213, 20582, 20951 or a fragment or variant of any of these sequences. Additional information regarding each of these suitable amino acid sequences encoding RSV proteins may also be derived from the sequence listing, in particular from the details provided therein under identifier <223> as explained in the following.

In further embodiments of the second aspect, the coding sequence of the further artificial RNA encodes at least one antigenic peptide or protein as defined herein and additionally a heterologous secretory signal sequence or heterologous secretory signal peptide. The heterologous secretory signal sequence may increase the secretion of the encoded antigenic peptide or protein.

Suitable secretory signal peptides may be selected from the list of amino acid sequences according to SEQ ID NOs: 1-1115 and SEQ ID NO: 1728 of the patent application WO2017/081082, or fragments or variants of these sequences. On nucleic acid level, any nucleic acid sequence (e.g. RNA sequence) may be selected which encodes such amino acid sequences. In this context, the disclosure of WO2017/081082 is herewith incorporated by reference.

According to embodiments, the secretory signal sequence comprises an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 21329-21362 or a fragment or variant of any of these sequences. Additional information regarding each of these suitable amino acid sequences encoding secretory signal sequences may also be derived from the sequence listing, in particular from the details provided therein under identifier <223>.

In preferred embodiments, the further artificial RNA of the composition comprises
- a) at least one heterologous 5' untranslated region (5'-UTR) and/or at least one heterologous 3' untranslated region (3'-UTR); and
- b) at least one coding sequence operably linked to said 3'-UTR and/or 5'-UTR encoding at least one antigenic peptide or protein derived from a RSV M, N, M2-1, and/or phosphoprotein P or a fragment or variant thereof, preferably encoding an amino acid sequence selected from any one of SEQ ID NOs: 9684, 10053-10133, 10134, 10503-10636, 10637, 11006-11182, 11183, 11552-11725, 19844, 20213, 20582, 20951 or a fragment or variant of any of these sequences.

In preferred embodiments, the further artificial RNA of the composition comprises
- a) at least one heterologous 5' untranslated region (5'-UTR) and/or at least one heterologous 3' untranslated region (3'-UTR); and
- b) at least one coding sequence operably linked to said 3'-UTR and/or 5'-UTR encoding at least one antigenic peptide or protein derived from a RSV M2-1 or a fragment or variant thereof, preferably encoding an amino acid sequence selected from any one of SEQ ID NOs: 11183, 20953, 21414 or a fragment or variant of any of these sequences.

Suitably, the further artificial RNA of the composition comprises a coding sequence is operably linked to a 3'-UTR and a 5'-UTR selected from a-1, a-2, a-3, a-4, a-5, b-1, b-2, b-3, b-4, b-5, c-1, c-2, c-3, c-4, c-5, d-1, d-2, d-3, d-4, d-5, e-1, e-2, e-3, e-4, e-5, e-6, f-1, f-2, f-3, f-4, f-5, g-1, g-2, g-3, g-4, g-5, h-1, h-2, h- 3, h-4, h-5, i-1, i-2, or i-3 (as defined in the context of the first aspect).

Suitably, the further artificial RNA of the composition comprises a coding sequence wherein at least one or more than one, or wherein preferably all uracil nucleotides are replaced by pseudouridine (ψ) nucleotides or N1-methylpseudouridine (m1ψ) nucleotides.

Accordingly, in other embodiments, the further artificial RNA of the composition may comprise a 5'-cap sequence element according to SEQ ID NOs: 43 or 21321, or a fragment or variant thereof.

In preferred embodiments of the second aspect, the coding sequence of the further RNA comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 9685-9692, 10135-10142, 10638-10645, 11184-11119, 19845-19852, 20214-20221, 20583-20590, 20952-20959, 21385-21388, 21411-21414 or a fragment or a fragment or variant of any of these sequences (cds optimizations as defined in the context of the first aspect). Additional information regarding each of these suitable amino acid sequences encoding RSV proteins may also be derived from the sequence listing, in particular from the details provided therein under identifier <223> as explained in the following.

In preferred embodiments of the second aspect, the further artificial RNA, preferably the further mRNA of the composition comprises preferably in 5'- to 3'-direction the following elements a)-i):
- a) 5'-cap structure, preferably as specified in the context of the first aspect, most preferably a Cap1 structure;
- b) optionally, 5'-UTR as specified in the context of the first aspect, preferably at least one selected from SEQ ID NOs: 1-22;
- c) a ribosome binding site, preferably as specified herein;
- d) at least one coding sequence selected from SEQ ID NOs: 9685-9692, 10135-10142, 10638-10645, 11184-11119, 19845-19852, 20214-20221, 20583-20590, 20952-20959, 21385-21388, 21411-21414;
- e) 3'-UTR as specified in the context of the first aspect, preferably at least one selected from SEQ ID NOs: 23-38;
- f) optionally, a poly(A) sequence, preferably as specified in the context of the first aspect;
- g) optionally, a poly(C) sequence, preferably as specified in the context of the first aspect;
- h) optionally, a histone stem-loop, preferably as specified in the context of the first aspect;
- i) optionally, a 3'-terminal sequence element as specified in the context of the first aspect, preferably according to according to SEQ ID NOs: 44-63, or 21322-21328, and wherein optionally at least one or more than one, preferably wherein all uracil nucleotides are replaced by pseudouridine (ψ) nucleotides or N1-methylpseudouridine (m1ψ) nucleotides.

In particularly preferred embodiments of the second aspect, the further artificial RNA, preferably the further mRNA of the composition comprises preferably in 5'- to 3'-direction the following elements a)-i):
- a) 5'-cap structure, preferably as specified in the context of the first aspect, most preferably a Cap1 structure;
- b) optionally, 5'-UTR as specified in the context of the first aspect, preferably at least one selected from SEQ ID NOs: 1-22;
- c) a ribosome binding site, preferably as specified herein;
- d) at least one coding sequence selected from SEQ ID NOs: 11185-11191, 21388, 20952-20959, 21414;
- e) 3'-UTR as specified in the context of the first aspect, preferably at least one selected from SEQ ID NOs: 23-38;
- f) optionally, a poly(A) sequence, preferably as specified in the context of the first aspect;
- g) optionally, a poly(C) sequence, preferably as specified in the context of the first aspect;
- h) optionally, a histone stem-loop, preferably as specified in the context of the first aspect;
- i) optionally, a 3'-terminal sequence element as specified in the context of the first aspect, preferably according to according to SEQ ID NOs: 44-63, or 21322-21328, and wherein optionally at least one or more than one, preferably wherein all uracil nucleotides are replaced by pseudouridine (ψ) nucleotides or N1-methylpseudouridine (m1ψ) nucleotides.

In that context, preferred RSV polypeptide, nucleic acid, and mRNA sequences of the second aspect are provided in Table 7A.

In Table 7A, Columns A to D represent specific suitable constructs of the second aspect derived from RSV protein, wherein Column A provides suitable sequences for M, Column B provides suitable sequences for N, Column C provides suitable sequences for P, and Column D provides suitable sequences M2-1.

The protein names/designs are indicated in row 1 (Columns A to D), the protein SEQ ID NOs as provided in the sequence listing are in row 2 ("PRT"). Preferred protein SEQ ID NOs of HRSV(A2) are provided in row 3 ("HRSV (A2) PRT"). The SEQ ID NOs of corresponding coding sequences for each indicated HRSV(A2) protein are provided in rows 4-11 ("cds wt", "cds opt1", "cds opt2", "cds opt3", "cds opt4", "cds opt5", "cds opt6", "cds opt11", respectively). The SEQ ID NOs of corresponding mRNA constructs comprising said coding sequences and suitable 3'-UTRs and 5'-UTRs according to the invention are provided in rows 12 to 55 ("mRNA design a-1" to "mRNA design i-3" as specified herein).

Preferred protein SEQ ID NOs of HRSV(Memphis-37) are provided in row 56 ("Memphis-37 PRT"). The SEQ ID NOs of corresponding coding sequences for each indicated HRSV(Memphis-37) protein are provided in rows 57-64 ("cds wt", "cds opt1", "cds opt2", "cds opt3", "cds opt4", "cds opt5", "cds opt6", "cds opt11", respectively). The SEQ ID NOs of corresponding mRNA constructs comprising said coding sequences and suitable 3'-UTRs and 5'-UTRs according to the invention are provided in rows 65 to 108 ("mRNA design a-1" to "mRNA design i-3" as specified herein).

Further information e.g. regarding the type of coding sequence comprised in the indicated mRNA constructs is provided in the <223> identifier of the respective SEQ ID NO in the sequence listing.

TABLE 7A

Preferred further coding sequences and mRNA constructs of the composition or vaccine

| 1 | Strain | Description | A<br>RSV M | B<br>RSV N | C<br>RSV P | D<br>RSV M2-1 |
|---|---|---|---|---|---|---|
| 2 | divers | PRT | 10053-10133 | 10503-10636 | 11006-11182 | 11552-11725 |
| 3 | HRSV(A2) | PRT | 9684 | 10134 | 10637 | 11183 |
| 4 | HRSV(A2) | cds wt | 9685 | 10135 | 10638 | 11184 |
| 5 | HRSV(A2) | CDS opt1 | 9686, 21385 | 10136, 21386 | 10639, 21387 | 11185, 21388 |
| 6 | HRSV(A2) | cds opt2 | 9687 | 10137 | 10640 | 11186 |
| 7 | HRSV(A2) | cds opt3 | 9688 | 10138 | 10641 | 11187 |
| 8 | HRSV(A2) | cds opt4 | 9689 | 10139 | 10642 | 11188 |
| 9 | HRSV(A2) | cds opt5 | 9690 | 10140 | 10643 | 11189 |
| 10 | HRSV(A2) | cds opt6 | 9691 | 10141 | 10644 | 11190 |
| 11 | HRSV(A2) | cds opt11 | 9692 | 10142 | 10645 | 11191 |
| 12 | HRSV(A2) | mRNA Design a-1 | 9693-9700, 21481, 21482, 21627, 21628 | 10143-10150, 21483, 21484, 21629, 21630 | 10646-10653, 21485, 21486, 21631, 21632 | 11192-11199, 21487, 21488, 21633, 21634 |
| 13 | HRSV(A2) | mRNA Design a-2 | 9701-9708 | 10151-10158 | 10654-10661 | 11200-11207 |
| 14 | HRSV(A2) | mRNA Design a-3 | 9709-9716 | 10159-10166 | 10662-10669 | 11208-11215 |
| 15 | HRSV(A2) | mRNA Design a-4 | 9717-9724 | 10167-10174 | 10670-10677 | 11216-11223 |
| 16 | HRSV(A2) | mRNA Design a-5 | 9725-9732 | 10175-10182 | 10678-10685 | 11224-11231 |
| 17 | HRSV(A2) | mRNA Design b-1 | 9733-9740 | 10183-10190 | 10686-10693 | 11232-11239 |
| 18 | HRSV(A2) | mRNA Design b-2 | 9741-9748 | 10191-10198 | 10694-10701 | 11240-11247 |
| 19 | HRSV(A2) | mRNA Design b-3 | 9749-9756 | 10199-10206 | 10702-10709 | 11248-11255 |
| 20 | HRSV(A2) | mRNA Design b-4 | 9757-9764 | 10207-10214 | 10710-10717 | 11256-11263 |
| 21 | HRSV(A2) | mRNA Design b-5 | 9765-9772 | 10215-10222 | 10718-10725 | 11264-11271 |
| 22 | HRSV(A2) | mRNA Design c-1 | 9773-9780 | 10223-10230 | 10726-10733 | 11272-11279 |
| 23 | HRSV(A2) | mRNA Design c-2 | 9781-9788 | 10231-10238 | 10734-10741 | 11280-11287 |
| 24 | HRSV(A2) | mRNA Design c-3 | 9789-9796 | 10239-10246 | 10742-10749 | 11288-11295 |
| 25 | HRSV(A2) | mRNA Design c-4 | 9797-9804 | 10247-10254 | 10750-10757 | 11296-11303 |
| 26 | HRSV(A2) | mRNA Design c-5 | 9805-9812 | 10255-10262 | 10758-10765 | 11304-11311 |
| 27 | HRSV(A2) | mRNA Design d-1 | 9813-9820 | 10263-10270 | 10766-10773 | 11312-11319 |
| 28 | HRSV(A2) | mRNA Design d-2 | 9821-9828 | 10271-10278 | 10774-10781 | 11320-11327 |
| 29 | HRSV(A2) | mRNA Design d-3 | 9829-9836 | 10279-10286 | 10782-10789 | 11328-11335 |
| 30 | HRSV(A2) | mRNA Design d-4 | 9837-9844 | 10287-10294 | 10790-10797 | 11336-11343 |
| 31 | HRSV(A2) | mRNA Design d-5 | 9845-9852 | 10295-10302 | 10798-10805 | 11344-11351 |
| 32 | HRSV(A2) | mRNA Design e-1 | 9853-9860 | 10303-10310 | 10806-10813 | 11352-11359 |
| 33 | HRSV(A2) | mRNA Design e-2 | 9861-9868 | 10311-10318 | 10814-10821 | 11360-11367 |
| 34 | HRSV(A2) | mRNA Design e-3 | 9869-9876 | 10319-10326 | 10822-10829 | 11368-11375 |
| 35 | HRSV(A2) | mRNA Design e-4 | 9877-9884 | 10327-10334 | 10830-10837 | 11376-11383 |
| 36 | HRSV(A2) | mRNA Design e-5 | 9885-9892 | 10335-10342 | 10838-10845 | 11384-11391 |
| 37 | HRSV(A2) | mRNA Design e-6 | 9893-9900 | 10343-10350 | 10846-10853 | 11392-11399 |
| 38 | HRSV(A2) | mRNA Design f-1 | 9901-9908 | 10351-10358 | 10854-10861 | 11400-11407 |
| 39 | HRSV(A2) | mRNA Design f-2 | 9909-9916 | 10359-10366 | 10862-10869 | 11408-11415 |
| 40 | HRSV(A2) | mRNA Design f-3 | 9917-9924 | 10367-10374 | 10870-10877 | 11416-11423 |
| 41 | HRSV(A2) | mRNA Design f-4 | 9925-9932 | 10375-10382 | 10878-10885 | 11424-11431 |
| 42 | HRSV(A2) | mRNA Design f-5 | 9933-9940 | 10383-10390 | 10886-10893 | 11432-11439 |
| 43 | HRSV(A2) | mRNA Design g-1 | 9941-9948 | 10391-10398 | 10894-10901 | 11440-11447 |
| 44 | HRSV(A2) | mRNA Design g-2 | 9949-9956 | 10399-10406 | 10902-10909 | 11448-11455 |
| 45 | HRSV(A2) | mRNA Design g-3 | 9957-9964 | 10407-10414 | 10910-10917 | 11456-11463 |
| 46 | HRSV(A2) | mRNA Design g-4 | 9965-9972 | 10415-10422 | 10918-10925 | 11464-11471 |
| 47 | HRSV(A2) | mRNA Design g-5 | 9973-9980 | 10423-10430 | 10926-10933 | 11472-11479 |
| 48 | HRSV(A2) | mRNA Design h-1 | 9981-9988 | 10431-10438 | 10934-10941 | 11480-11487 |
| 49 | HRSV(A2) | mRNA Design h-2 | 9989-9996 | 10439-10446 | 10942-10949 | 11488-11495 |
| 50 | HRSV(A2) | mRNA Design h-3 | 9997-10004 | 10447-10454 | 10950-10957 | 11496-11503 |
| 51 | HRSV(A2) | mRNA Design h-4 | 10005-10012 | 10455-10462 | 10958-10965 | 11504-11511 |
| 52 | HRSV(A2) | mRNA Design h-5 | 10013-10020 | 10463-10470 | 10966-10973 | 11512-11519 |
| 53 | HRSV(A2) | mRNA Design i-1 | 10021-10028 | 10471-10478 | 10974-10981 | 11520-11527 |

TABLE 7A-continued

Preferred further coding sequences and mRNA constructs of the composition or vaccine

| 1 | Strain | Description | A<br>RSV M | B<br>RSV N | C<br>RSV P | D<br>RSV M2-1 |
|---|---|---|---|---|---|---|
| 54 | HRSV(A2) | mRNA Design i-2 | 10029-10044 | 10479-10494 | 10982-10997 | 11528-11543 |
| 55 | HRSV(A2) | mRNA Design i-3 | 10045-10052 | 10495-10502 | 10998-11005 | 11544-11551 |
| 56 | Memphis-37 | PRT | 19844 | 20213 | 20582 | 20951 |
| 57 | Memphis-37 | CDS wt | 19845 | 20214 | 20583 | 20952 |
| 58 | Memphis-37 | CDS opt1 | 19846, 21411 | 20215, 21412 | 20584, 21413 | 20953, 21414 |
| 59 | Memphis-37 | CDS opt2 | 19847 | 20216 | 20585 | 20954 |
| 60 | Memphis-37 | CDS opt3 | 19848 | 20217 | 20586 | 20955 |
| 61 | Memphis-37 | CDS opt4 | 19849 | 20218 | 20587 | 20956 |
| 62 | Memphis-37 | CDS opt5 | 19850 | 20219 | 20588 | 20957 |
| 63 | Memphis-37 | CDS opt6 | 19851 | 20220 | 20589 | 20958 |
| 64 | Memphis-37 | CDS opt11 | 19852 | 20221 | 20590 | 20959 |
| 65 | Memphis-37 | mRNA Design a-1 | 19853-19860,<br>21553, 21554,<br>21699, 21700 | 20222-20229,<br>21555, 21556,<br>21701, 21702 | 20591-20598,<br>21557, 21558,<br>21703, 21704 | 20960-20967,<br>21559, 21560,<br>21705, 21706 |
| 66 | Memphis-37 | mRNA Design a-2 | 19861-19868 | 20230-20237 | 20599-20606 | 20968-20975 |
| 67 | Memphis-37 | mRNA Design a-3 | 19869-19876 | 20238-20245 | 20607-20614 | 20976-20983 |
| 68 | Memphis-37 | mRNA Design a-4 | 19877-19884 | 20246-20253 | 20615-20622 | 20984-20991 |
| 69 | Memphis-37 | mRNA Design a-5 | 19885-19892 | 20254-20261 | 20623-20630 | 20992-20999 |
| 70 | Memphis-37 | mRNA Design b-1 | 19893-19900 | 20262-20269 | 20631-20638 | 21000-21007 |
| 71 | Memphis-37 | mRNA Design b-2 | 19901-19908 | 20270-20277 | 20639-20646 | 21008-21015 |
| 72 | Memphis-37 | mRNA Design b-3 | 19909-19916 | 20278-20285 | 20647-20654 | 21016-21023 |
| 73 | Memphis-37 | mRNA Design b-4 | 19917-19924 | 20286-20293 | 20655-20662 | 21024-21031 |
| 74 | Memphis-37 | mRNA Design b-5 | 19925-19932 | 20294-20301 | 20663-20670 | 21032-21039 |
| 75 | Memphis-37 | mRNA Design c-1 | 19933-19940 | 20302-20309 | 20671-20678 | 21040-21047 |
| 76 | Memphis-37 | mRNA Design c-2 | 19941-19948 | 20310-20317 | 20679-20686 | 21048-21055 |
| 77 | Memphis-37 | mRNA Design c-3 | 19949-19956 | 20318-20325 | 20687-20694 | 21056-21063 |
| 78 | Memphis-37 | mRNA Design c-4 | 19957-19964 | 20326-20333 | 20695-20702 | 21064-21071 |
| 79 | Memphis-37 | mRNA Design c-5 | 19965-19972 | 20334-20341 | 20703-20710 | 21072-21079 |
| 80 | Memphis-37 | mRNA Design d-1 | 19973-19980 | 20342-20349 | 20711-20718 | 21080-21087 |
| 81 | Memphis-37 | mRNA Design d-2 | 19981-19988 | 20350-20357 | 20719-20726 | 21088-21095 |
| 82 | Memphis-37 | mRNA Design d-3 | 19989-19996 | 20358-20365 | 20727-20734 | 21096-21103 |
| 83 | Memphis-37 | mRNA Design d-4 | 19997-20004 | 20366-20373 | 20735-20742 | 21104-21111 |
| 84 | Memphis-37 | mRNA Design d-5 | 20005-20012 | 20374-20381 | 20743-20750 | 21112-21119 |
| 85 | Memphis-37 | mRNA Design e-1 | 20013-20020 | 20382-20389 | 20751-20758 | 21120-21127 |
| 86 | Memphis-37 | mRNA Design e-2 | 20021-20028 | 20390-20397 | 20759-20766 | 21128-21135 |
| 87 | Memphis-37 | mRNA Design e-3 | 20029-20036 | 20398-20405 | 20767-20774 | 21136-21143 |
| 88 | Memphis-37 | mRNA Design e-4 | 20037-20044 | 20406-20413 | 20775-20782 | 21144-21151 |
| 89 | Memphis-37 | mRNA Design e-5 | 20045-20052 | 20414-20421 | 20783-20790 | 21152-21159 |
| 90 | Memphis-37 | mRNA Design e-6 | 20053-20060 | 20422-20429 | 20791-20798 | 21160-21167 |
| 91 | Memphis-37 | mRNA Design f-1 | 20061-20068 | 20430-20437 | 20799-20806 | 21168-21175 |
| 92 | Memphis-37 | mRNA Design f-2 | 20069-20076 | 20438-20445 | 20807-20814 | 21176-21183 |
| 93 | Memphis-37 | mRNA Design f-3 | 20077-20084 | 20446-20453 | 20815-20822 | 21184-21191 |
| 94 | Memphis-37 | mRNA Design f-4 | 20085-20092 | 20454-20461 | 20823-20830 | 21192-21199 |
| 95 | Memphis-37 | mRNA Design f-5 | 20093-20100 | 20462-20469 | 20831-20838 | 21200-21207 |
| 96 | Memphis-37 | mRNA Design g-1 | 20101-20108 | 20470-20477 | 20839-20846 | 21208-21215 |
| 97 | Memphis-37 | mRNA Design g-2 | 20109-20116 | 20478-20485 | 20847-20854 | 21216-21223 |
| 98 | Memphis-37 | mRNA Design g-3 | 20117-20124 | 20486-20493 | 20855-20862 | 21224-21231 |
| 99 | Memphis-37 | mRNA Design g-4 | 20125-20132 | 20494-20501 | 20863-20870 | 21232-21239 |
| 100 | Memphis-37 | mRNA Design g-5 | 20133-20140 | 20502-20509 | 20871-20878 | 21240-21247 |
| 101 | Memphis-37 | mRNA Design h-1 | 20141-20148 | 20510-20517 | 20879-20886 | 21248-21255 |
| 102 | Memphis-37 | mRNA Design h-2 | 20149-20156 | 20518-20525 | 20887-20894 | 21256-21263 |
| 103 | Memphis-37 | mRNA Design h-3 | 20157-20164 | 20526-20533 | 20895-20902 | 21264-21271 |
| 104 | Memphis-37 | mRNA Design h-4 | 20165-20172 | 20534-20541 | 20903-20910 | 21272-21279 |
| 105 | Memphis-37 | mRNA Design h-5 | 20173-20180 | 20542-20549 | 20911-20918 | 21280-21287 |
| 106 | Memphis-37 | mRNA Design i-1 | 20181-20188 | 20550-20557 | 20919-20926 | 21288-21295 |
| 107 | Memphis-37 | mRNA Design i-2 | 20189-20204 | 20558-20573 | 20927-20942 | 21296-21311 |
| 108 | Memphis-37 | mRNA Design i-3 | 20205-20212 | 20574-20581 | 20943-20950 | 21312-21319 |

Accordingly, in preferred embodiments, the composition of the second aspect comprises at least one further artificial RNA comprising at least one coding sequence encoding at least one antigenic peptide or protein derived from RSV selected from matrix protein M, nucleoprotein N, M2-1 protein, phosphoprotein P, wherein the further artificial RNA comprises or consists of an RNA sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 9693-10052, 10143-10502, 10646-11005, 11192-11551, 19853-20212, 20222-20581, 20591-20950, 20960-21319, 21481-21488, 21627-21634, 21553-21560, 21699-21706 or a fragment or variant of any of these sequences, wherein, optionally, at least one or more than one, or wherein all uracil nucleotides are replaced by pseudouridine (ψ) nucleotides or N1-methylpseudouridine (m1ψ) nucleotides. Additional information regarding each of these suitable amino acid sequences encoding RSV proteins may also be derived from the sequence listing, in particular from the details provided therein under identifier <223> as explained in the following.

In particularly preferred embodiments of the second aspect, the composition of the second aspect comprises at least one artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 78-482, 493-897, 907-1266, 1276-1635, 1645-2004, 2014-2373, 2383-2742, 2752-3111, 3121-3480, 3490-3849, 3859-4218, 4228-4587, 4597-4956, 4966-5325, 5335-5694, 5704-6063, 6073-6432, 6442-6801, 6811-7170, 7180-7539, 7549-7908, 7918-8277, 8278, 11735-12094, 12104-12463, 12473-12832, 12842-13201, 13949-14308, 14318-14677, 14687-15046, 15056-15415, 15425-15784, 15794-16153, 13211-13570, 13580-13939, 16163-16522, 16532-16891, 16901-17260, 17270-17629, 17639-17998, 18008-18367, 18377-18736, 18746-19105, 19115-19474, 19484-19843, 21415-21480, 21561-21626, 21489-21552, 21635-21698 (encoding RSV F as defined in the first aspect) and a further artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 9693-10052, 19853-20212, 21481, 21482, 21627, 21628, 21553, 21554, 21699, 21700 (encoding RSV M); or at least one artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 78-482, 493-897, 907-1266, 1276-1635, 1645-2004, 2014-2373, 2383-2742, 2752-3111, 3121-3480, 3490-3849, 3859-4218, 4228-4587, 4597-4956, 4966-5325, 5335-5694, 5704-6063, 6073-6432, 6442-6801, 6811-7170, 7180-7539, 7549-7908, 7918-8277, 8278, 11735-12094, 12104-12463, 12473-12832, 12842-13201, 13949-14308, 14318-14677, 14687-15046, 15056-15415, 15425-15784, 15794-16153, 13211-13570, 13580-13939, 16163-16522, 16532-16891, 16901-17260, 17270-17629, 17639-17998, 18008-18367, 18377-18736, 18746-19105, 19115-19474, 19484-19843, 21415-21480, 21561-21626, 21489-21552, 21635-21698 (encoding RSV F as defined in the first aspect) and a further artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 10143-10502, 20222-20581, 21483, 21484, 21629, 21630, 21555, 21556, 21701, 21702 (encoding RSV N); or at least one artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 78-482, 493-897, 907-1266, 1276-1635, 1645-2004, 2014-2373, 2383-2742, 2752-3111, 3121-3480, 3490-3849, 3859-4218, 4228-4587, 4597-4956, 4966-5325, 5335-5694, 5704-6063, 6073-6432, 6442-6801, 6811-7170, 7180-7539, 7549-7908, 7918-8277, 8278, 11735-12094, 12104-12463, 12473-12832, 12842-13201, 13949-14308, 14318-14677, 14687-15046, 15056-15415, 15425-15784, 15794-16153, 13211-13570, 13580-13939, 16163-16522, 16532-16891, 16901-17260, 17270-17629, 17639-17998, 18008-18367, 18377-18736, 18746-19105, 19115-19474, 19484-19843, 21415-21480, 21561-21626, 21489-21552, 21635-21698 (encoding RSV F as defined in the first aspect) and at least one further artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 10646-11005, 20591-20950, 21485, 21486, 21631, 21632, 21557, 21558, 21703, 21704 (encoding RSV P); or at least one artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 78-482, 493-897, 907-1266, 1276-1635, 1645-2004, 2014-2373, 2383-2742, 2752-3111, 3121-3480, 3490-3849, 3859-4218, 4228-4587, 4597-4956, 4966-5325, 5335-5694, 5704-6063, 6073-6432, 6442-6801, 6811-7170, 7180-7539, 7549-7908, 7918-8277, 8278, 11735-12094, 12104-12463, 12473-12832, 12842-13201, 13949-14308, 14318-14677, 14687-15046, 15056-15415, 15425-15784, 15794-16153, 13211-13570, 13580-13939, 16163-16522, 16532-16891, 16901-17260, 17270-17629, 17639-17998, 18008-18367, 18377-18736, 18746-19105, 19115-19474, 19484-19843, 21415-21480, 21561-21626, 21489-21552, 21635-21698 (encoding RSV F as defined in the first aspect) and at least one further artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 11192-11551, 20960-21319, 21487, 21488, 21633, 21634, 21559, 21560, 21705, 21706 (encoding RSV M2-1); or at least one artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 78-482, 493-897, 907-1266, 1276-1635, 1645-2004, 2014-2373, 2383-2742, 2752-3111, 3121-3480, 3490-3849, 3859-4218, 4228-4587, 4597-4956, 4966-5325, 5335-5694, 5704-6063, 6073-6432, 6442-6801, 6811-7170, 7180-7539, 7549-7908, 7918-8277, 8278, 11735-12094, 12104-12463, 12473-12832, 12842-13201, 13949-14308, 14318-14677, 14687-15046, 15056-15415, 15425-15784, 15794-16153, 13211-13570, 13580-13939, 16163-16522, 16532-16891, 16901-17260, 17270-17629, 17639-17998, 18008-18367, 18377-18736, 18746-19105, 19115-19474, 19484-19843, 21415-21480, 21561-21626, 21489-21552, 21635-21698 (encoding RSV F as defined in the first aspect) and at least one further artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 9693-10052, 19853-20212, 21481, 21482, 21627, 21628, 21553, 21554, 21699, 21700 (encoding RSV M) and a further artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 10646-11005, 20591-20950, 21485, 21486, 21631, 21632, 21557, 21558, 21703, 21704 (encoding RSV P);

at least one artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 78-482, 493-897, 907-1266, 1276-1635, 1645-2004, 2014-2373, 2383-2742, 2752-3111, 3121-3480, 3490-3849, 3859-4218, 4228-4587, 4597-4956, 4966-5325, 5335-5694, 5704-6063, 6073-6432, 6442-6801, 6811-7170, 7180-7539, 7549-7908, 7918-8277, 8278, 11735-12094, 12104-12463, 12473-12832, 12842-13201, 13949-14308, 14318-14677, 14687-15046, 15056-15415, 15425-15784, 15794-16153, 13211-13570, 13580-13939, 16163-16522, 16532-16891, 16901-17260, 17270-17629, 17639-17998, 18008-18367, 18377-18736, 18746-19105, 19115-19474, 19484-19843, 21415-21480, 21561-21626, 21489-21552, 21635-21698 (encoding RSV F as defined in the first aspect) and at least one further artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 9693-10052, 19853-20212, 21481, 21482, 21627, 21628, 21553, 21554, 21699, 21700 (encoding RSV M) and a further artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 10646-11005, 20591-20950, 21485, 21486, 21631, 21632, 21557, 21558, 21703, 21704 (encoding RSV P) and a further artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 10143-10502, 20222-20581, 21483, 21484, 21629, 21630, 21555, 21556, 21701, 21702 (encoding RSV N), or at least one artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 78-86, 21415-21417, 21561-21563, 474-482, 11735-11742, 21489, 21490, 21635, 21636, 12087-12094, 493-501, 21418-21420, 21564-21566, 889-897, 12104-12111, 21491, 21492, 21637, 21638, 12456-12463, 907-914, 21421-21423, 21567-21569, 1259-1266, 12473-12480, 21493-21495, 21639-21641, 12825-12832, 1276-1283, 21424-21426, 21570-21572, 1628-1635, 12842-12849, 21496-21498, 21642-21644, 13194-13201, 1645-1652, 21433-21435, 21579-21581, 1997-2004, 13949-13956, 21505-21507, 21651-21653, 14301-14308, 2014-2021, 21436-21438, 21582-21584, 2366-2373, 14318-14325, 21508-21510, 21654-21656, 14670-14677, 2383-2390, 21439-21441, 21585-21587, 2735-2742, 14687-14694, 21511-21513, 21657-21659, 15039-15046, 2752-2759, 21442-21444, 21588-21590, 3104-3111, 15056-15063, 21514-21516, 21660-21662, 15408-15415, 3121-3128, 21445-21447, 21591-21593, 3473-3480, 15425-15432, 21517-21519, 21663-21665, 15777-15784, 3490-3497, 21448-21450, 21594-21596, 3842-3849, 15794-15801, 21520-21522, 21666-21668, 16146-16153, 3859-3866, 21427-21429, 21573-21575, 4211-4218, 13211-13218, 21499-21501, 21645-21647, 13563-13570, 4228-4235, 21430-21432, 21576-21578, 4580-4587, 13580-13587, 21502-21504, 21648-21650, 13932-13939, 4597-4604, 21451-21453, 21597-21599, 4949-4956, 16163-16170, 21523-21525, 21669-21671, 16515-16522, 4966-4973, 21454-21456, 21600-21602, 5318-5325, 16532-16539, 21526-21528, 21672-21674, 16884-16891, 5335-5342, 21457-21459, 21603-21605, 5687-5694, 16901-16908, 21529-21531, 21675-21677, 17253-17260, 5704-5711, 21460-21462, 21606-21608, 6056-6063, 17270-17277, 21532-21534, 21678-21680, 17622-17629 (encoding RSV F as defined in the first aspect) and at least one further artificial RNA which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 11192-11551, 20960-21319, 21487, 21488, 21633, 21634, 21559, 21560, 21705, 21706 (encoding RSV M2-1), wherein, optionally, at least one or more than one, or wherein all uracil nucleotides are replaced by pseudouridine (ψ) nucleotides or N1-methylpseudouridine (m1ψ) nucleotides.

In various embodiments, different combinations of RSV F (F0, F-del, F0_DSCav1, F-del_DSCav1, F_DSCav1_mut0, F-del_DSCav1_mut0, F_DSCav1_mut1, F-del_DSCav1_mut1, F_DSCav1_mut2, F-del_DSCav1_mut2, F_DSCav1_mut3, F-del_DSCav1_mut3, F_DSCav1_mut4, F-del_DSCav1_mut4, F_DSCav1_mut5, F-del_DSCav1_mut5, F_DSCav1_mut6, F-del_DSCav1_mut6, F_DSCav1_mut7, F-del_DSCav1_mut7, F_DSCav1_mut8, F-del_DSCav1_mut8) RNA constructs and RSV T-cell antigen RNA constructs (RSV M, N, M2-1, or P) are suitably comprised in the composition (as disclosed in Table 7B; combinations 1-64). The combinations 49-64 are preferred, combination 64 is particularly preferred.

TABLE 7B

Suitable combinations of RNA constructs encoding RSV F and RNA constructs encoding T-cell antigens

| Combination | RSV F construct | SEQ ID NO: Protein | T-cell antigen construct | SEQ ID NO: Protein |
| --- | --- | --- | --- | --- |
| 1 | F0 | 68 | M | 9684 |
| 2 | F-del | 483 | M | 9684 |
| 3 | F_DSCav1 | 898 | M | 9684 |
| 4 | F-del_DSCav1 | 1267 | M | 9684 |
| 5 | F_DSCav1_mut1 | 1636 | M | 9684 |
| 6 | F-del_DSCav1_mut1 | 2005 | M | 9684 |
| 7 | F_DSCav1_mut2 | 2374 | M | 9684 |
| 8 | F-del_DSCav1_mut2 | 2743 | M | 9684 |
| 9 | F_DSCav1_mut3 | 3112 | M | 9684 |
| 10 | F-del_DSCav1_mut3 | 3481 | M | 9684 |
| 11 | F_DSCav1_mut0 | 3850 | M | 9684 |
| 12 | F-del_DSCav1_mut0 | 4219 | M | 9684 |
| 13 | F_DSCav1_mut4 | 4588 | M | 9684 |

TABLE 7B-continued

Suitable combinations of RNA constructs encoding
RSV F and RNA constructs encoding T-cell antigens

| Combination | RSV F construct | SEQ ID NO: Protein | T-cell antigen construct | SEQ ID NO: Protein |
|---|---|---|---|---|
| 14 | F-del_DSCav1_mut4 | 4957 | M | 9684 |
| 15 | F_DSCav1_mut5 | 5326 | M | 9684 |
| 16 | F-del_DSCav1_mut5 | 5695 | M | 9684 |
| 17 | F0 | 68 | N | 10134 |
| 18 | F-del | 483 | N | 10134 |
| 19 | F_DSCav1 | 898 | N | 10134 |
| 20 | F-del_DSCav1 | 1267 | N | 10134 |
| 21 | F_DSCav1_mut1 | 1636 | N | 10134 |
| 22 | F-del_DSCav1_mut1 | 2005 | N | 10134 |
| 23 | F_DSCav1_mut2 | 2374 | N | 10134 |
| 24 | F-del_DSCav1_mut2 | 2743 | N | 10134 |
| 25 | F_DSCav1_mut3 | 3112 | N | 10134 |
| 26 | F-del_DSCav1_mut3 | 3481 | N | 10134 |
| 27 | F_DSCav1_mut0 | 3850 | N | 10134 |
| 28 | F-del_DSCav1_mut0 | 4219 | N | 10134 |
| 29 | F_DSCav1_mut4 | 4588 | N | 10134 |
| 30 | F-del_DSCav1_mut4 | 4957 | N | 10134 |
| 31 | F_DSCav1_mut5 | 5326 | N | 10134 |
| 32 | F-del_DSCav1_mut5 | 5695 | N | 10134 |
| 33 | F0 | 68 | P | 10637 |
| 34 | F-del | 483 | P | 10637 |
| 35 | F_DSCav1 | 898 | P | 10637 |
| 36 | F-del_DSCav1 | 1267 | P | 10637 |
| 37 | F_DSCav1_mut1 | 1636 | P | 10637 |
| 38 | F-del_DSCav1_mut1 | 2005 | P | 10637 |
| 39 | F_DSCav1_mut2 | 2374 | P | 10637 |
| 40 | F-del_DSCav1_mut2 | 2743 | P | 10637 |
| 41 | F_DSCav1_mut3 | 3112 | P | 10637 |
| 42 | F-del_DSCav1_mut3 | 3481 | P | 10637 |
| 43 | F_DSCav1_mut0 | 3850 | P | 10637 |
| 44 | F-del_DSCav1_mut0 | 4219 | P | 10637 |
| 45 | F_DSCav1_mut4 | 4588 | P | 10637 |
| 46 | F-del_DSCav1_mut4 | 4957 | P | 10637 |
| 47 | F_DSCav1_mut5 | 5326 | P | 10637 |
| 48 | F-del_DSCav1_mut5 | 5695 | P | 10637 |
| 49 | F0 | 68 | M2-1 | 11183 |
| 50 | F-del | 483 | M2-1 | 11183 |
| 51 | F_DSCav1 | 898 | M2-1 | 11183 |
| 52 | F-del_DSCav1 | 1267 | M2-1 | 11183 |
| 53 | F_DSCav1_mut1 | 1636 | M2-1 | 11183 |
| 54 | F-del_DSCav1_mut1 | 2005 | M2-1 | 11183 |
| 55 | F_DSCav1_mut2 | 2374 | M2-1 | 11183 |
| 56 | F-del_DSCav1_mut2 | 2743 | M2-1 | 11183 |
| 57 | F_DSCav1_mut3 | 3112 | M2-1 | 11183 |
| 58 | F-del_DSCav1_mut3 | 3481 | M2-1 | 11183 |
| 59 | F_DSCav1_mut0 | 3850 | M2-1 | 11183 |
| 60 | F-del_DSCav1_mut0 | 4219 | M2-1 | 11183 |
| 61 | F_DSCav1_mut4 | 4588 | M2-1 | 11183 |
| 62 | F-del_DSCav1_mut4 | 4957 | M2-1 | 11183 |
| 63 | F_DSCav1_mut5 | 5326 | M2-1 | 11183 |
| 64 | F-del_DSCav1_mut5 | 5695 | M2-1 | 11183 |

Table 7B discloses compositions of the second aspect comprising at least one RNA encoding RSV F from the strain A2 as defined in the first aspect and at least one further artificial RNA comprising at least one coding sequence encoding at least one antigenic peptide or protein derived from RSV from the strain A2 selected from matrix protein M, nucleoprotein N, M2-1 protein, phosphoprotein P. In further embodiments of the invention all disclosed compositions in Table 7B are also applicable for antigenic peptides or proteins derived from a RSV isolate Memphis-37 (strain Memphis-37).

In a particularly preferred embodiment, the composition comprises one RSV F RNA construct (F0, F-del, F0_DSCav1, F-del_DSCav1, F_DSCav1_mut0, F-del_DSCav1_mut0, F-del_DSCav1_mut1, F_DSCav1_mut1, F-del_DSCav1_mut2, F_DSCav1_mut2, F-del_DSCav1_mut2, F_DSCav1_mut3, F-del_DSCav1_mut3, F_DSCav1_mut4, F-del_DSCav1_mut4, F_DSCav1_mut5, F-del_DSCav1_mut5, F_DSCav1_mut6, F-del_DSCav1_mut6, F_DSCav1_mut7, F-del_DSCav1_mut7, F_DSCav1_mut8, F-del_DSCav1_mut8) and, in addition, one RSV M2-1 RNA construct, preferably F-del_DSCav1_mut5 and M2-1.

In particularly preferred embodiments, one RNA construct encoding RSV F, selected from SEQ ID NOs: 5704-5711, 21460-21462, 21606-21608, 17270-17277, 21532-21534, 21678-21680 and one RNA construct encoding M2-1, selected from SEQ ID NOs: 11192-11199, 21487, 21488, 21633, 21634, 20960-20967, 21559, 21560, 21705, 21706 are comprised in the composition of the invention.

In various embodiments, the at least one artificial RNA of the first aspect and the at least one further artificial RNA as specified herein are derived from the same RSV virus (e.g. any virus selected from List 1).

In preferred embodiments, the at least one artificial RNA of the first aspect is derived from HRSV(A2) and the at least one further artificial RNA as specified herein is derived from HRSV(A2).

In preferred embodiments, the at least one artificial RNA of the first aspect is derived from HRSV(Memphis-37) and the at least one further artificial RNA as specified herein is derived from HRSV(Memphis-37).

It has to be understood that in the context of the invention, certain combinations of coding sequences may be generated by any combination of monocistronic, bicistronic and multicistronic artificial nucleic acids and/or multi-antigen-constructs/nucleic acid to obtain a nucleic acid composition encoding multiple antigenic peptides or proteins as defined herein.

Furthermore, one or more compatible solid or liquid fillers or diluents or encapsulating compounds may be used as well, which are suitable for administration to a person. The term "compatible" as used herein means that the constituents of the composition are capable of being mixed with the at least one RNA and, optionally, the further artificial RNA of the composition, in such a manner that no interaction occurs, which would substantially reduce the biological activity or the pharmaceutical effectiveness of the composition under typical use conditions. Pharmaceutically acceptable carriers, fillers and diluents must have sufficiently high purity and sufficiently low toxicity to make them suitable for administration to a person to be treated. Compounds which may be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

Further additives, which may be included in the composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

Complexation:

In a preferred embodiment of the second aspect, the at least one artificial RNA of the first aspect and, optionally, the further artificial RNA of the second aspect, is complexed or associated with or at least partially complexed or partially associated with one or more cationic or polycationic compound, preferably cationic or polycationic polymer, cationic or polycationic polysaccharide, cationic or polycationic lipid, cationic or polycationic protein, cationic or polycationic peptide, or any combinations thereof.

The term "cationic or polycationic compound" as used herein will be recognized and understood by the person of ordinary skill in the art, and are for example intended to refer to a charged molecule, which is positively charged at a pH value ranging from about 1 to 9, at a pH value ranging from about 3 to 8, at a pH value ranging from about 4 to 8, at a pH value ranging from about 5 to 8, more preferably at a pH value ranging from about 6 to 8, even more preferably at a pH value ranging from about 7 to 8, most preferably at a physiological pH, e.g. ranging from about 7.2 to about 7.5.

Accordingly, a cationic component, e.g. a cationic peptide, cationic protein, cationic polymer, cationic polysaccharide, cationic lipid may be any positively charged compound or polymer which is positively charged under physiological conditions. A "cationic or polycationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the given conditions.

Cationic or polycationic compounds, being particularly preferred in this context may be selected from the following list of cationic or polycationic peptides or proteins of fragments thereof: protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides, pAntp, plsl, FGF, Lactoferrin, Transportan, Buforin-2, Bac715-24, SynB, SynB(1), pVEC, hCT-derived peptides, SAP, or histones. More preferably, the nucleic acid as defined herein, preferably the mRNA as defined herein, is complexed with one or more polycations, preferably with protamine or oligofectamine, most preferably with protamine.

In a preferred embodiment of the second aspect, the at least one artificial RNA of the first aspect and, optionally, the further artificial RNA of the second aspect, is complexed with protamine Further preferred cationic or polycationic compounds, which can be used as transfection or complexation agent may include cationic polysaccharides, for example chitosan, polybrene etc.; cationic lipids, e.g. DOTMA, DMRIE, di-C14-amidine, DOTIM, SAINT, DC-Chol, BGTC, CTAP, DOPC, DODAP, DOPE: Dioleyl phosphatidylethanolamine, DOSPA, DODAB, DOIC, DMEPC, DOGS, DIMRI, DOTAP, DC-6-14, CLIP1, CLIP6, CLIP9, oligofectamine; or cationic or polycationic polymers, e.g. modified polyaminoacids, such as beta-aminoacid-polymers or reversed polyamides, etc., modified polyethylenes, such as PVP etc., modified acrylates, such as pDMAEMA etc., modified amidoamines such as pAMAM etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI, poly(propyleneimine), etc., polyallylamine, sugar backbone based polymers, such as cyclodextrin based polymers, dextran based polymers, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

In this context it is particularly preferred that the at least one artificial RNA as defined herein and, optionally, the further artificial RNA of the second aspect, is complexed or at least partially complexed with a cationic or polycationic compound and/or a polymeric carrier, preferably cationic proteins or peptides. In this context, the disclosure of WO2010/037539 and WO2012/113513 is incorporated herewith by reference. Partially means that only a part of the artificial nucleic acid is complexed with a cationic compound and that the rest of the artificial nucleic acid is (comprised in the inventive (pharmaceutical) composition) in uncomplexed form ("free").

In a preferred embodiment of the second aspect, the at least one artificial RNA of the first aspect and, optionally, the further artificial RNA of the second aspect, is complexed with one or more cationic or polycationic compounds, preferably protamine, and at least one free artificial RNA of the first aspect and, optionally the further RNA of the second aspect.

In this context it is particularly preferred that the at least one artificial RNA as defined herein, and, optionally, the further artificial RNA of the second aspect, is complexed, or at least partially complexed with protamine. Preferably, the molar ratio of the nucleic acid, particularly the RNA of the protamine-complexed RNA to the free RNA may be selected from a molar ratio of about 0.001:1 to about 1:0.001, including a ratio of about 1:1. Suitably, the complexed RNA is complexed with protamine by addition of protamine-trehalose solution to the RNA sample at a RNA:protamine weight to weight ratio (w/w) of 2:1.

Further preferred cationic or polycationic proteins or peptides that may be used for complexation can be derived from formula (Arg)l;(Lys)m;(His)n;(Orn)o;(Xaa)x of the patent application WO2009/030481 or WO2011/026641, the disclosure of WO2009/030481 or WO2011/026641 relating thereto incorporated herewith by reference.

In a preferred embodiment of the second aspect, the at least one artificial RNA of the first aspect and, optionally, the further artificial RNA of the second aspect, is complexed, or at least partially complexed with at least one cationic or polycationic proteins or peptides preferably selected from SEQ ID NOs: 64-67, 21320 or any combinations thereof.

According to embodiments, the composition of the present invention comprises the RNA as defined herein, and a polymeric carrier.

The term "polymeric carrier" as used herein will be recognized and understood by the person of ordinary skill in the art, and are for example intended to refer to a compound that facilitates transport and/or complexation of another compound (cargo). A polymeric carrier is typically a carrier that is formed of a polymer. A polymeric carrier may be associated to its cargo (nucleic acid, RNA) by covalent or non-covalent interaction.

A suitable polymeric carrier may be a polymeric carrier formed by disulfide-crosslinked cationic compounds. The disulfide-crosslinked cationic compounds may be the same or different from each other. The polymeric carrier can also contain further components. The polymeric carrier used according to the present invention may comprise mixtures of cationic peptides, proteins or polymers and optionally further components as defined herein, which are crosslinked by disulfide bonds (via —SH groups).

In this context, polymeric carriers according to formula {(Arg)l;(Lys)m;(His)n;(Orn)o;(Xaa')x(Cys)y} and formula Cys,{(Arg)l;(Lys)m;(His)n;(Orn)o;(Xaa)x}Cys$_2$ of the patent application WO2012/013326 are preferred, the disclosure of WO2012/013326 relating thereto incorporated herewith by reference.

In embodiments, the polymeric carrier used to complex the RNA as defined herein may be derived from a polymeric carrier molecule according formula (L-P$^1$—S—[S—P$^2$—S]$_n$—S—P$^3$-L) of the patent application WO2011/026641, the disclosure of WO2011/026641 relating thereto incorporated herewith by reference.

In embodiments, the polymeric carrier compound is formed by, or comprises or consists of the peptide elements CysArg12Cys (SEQ ID NO: 64) or CysArg12 (SEQ ID NO: 65) or TrpArg12Cys (SEQ ID NO: 66). In particularly preferred embodiments, the polymeric carrier compound consists of a (R$_{12}$C)—(R$_{12}$C) dimer, a (WR$_{12}$C)—(WR$_{12}$C) dimer, or a (CR$_{12}$)—(CR$_{12}$)—(CR$_{12}$) trimer, wherein the individual peptide elements in the dimer (e.g. (WR12C)), or the trimer (e.g. (CR12)), are connected via —SH groups.

In a preferred embodiment of the second aspect, the at least one artificial RNA of the first aspect and optionally the further artificial RNA of the second aspect, is complexed or associated with a polyethylene glycol/peptide polymer comprising HO-PEG5000-S—(S—CHHHHHHRRR-RHHHHHHC—S-)7-S-PEG5000-OH (SEQ ID NO: 67 as peptide monomer).

In a further preferred embodiment of the second aspect, the at least one artificial RNA of the first aspect and, optionally, the further artificial RNA of the second aspect, is complexed or associated with a polyethylene glycol/peptide polymer comprising HO-PEG5000-S—(S—CHHHHHHRRRRHHHHHHC—S-)4-S-PEG5000-OH (SEQ ID NO: 67 as peptide monomer).

In a further preferred embodiment of the second aspect, the at least one artificial RNA of the first aspect and, optionally, the further artificial RNA of the second aspect, is complexed or associated with a polyethylene glycol/peptide polymer comprising HO-PEG5000-S—(S—CGHHHHHRRRRHHHHHGC—S-)7-S-PEG5000-OH (SEQ ID NO: 21320 as peptide monomer).

In a further preferred embodiment of the second aspect, the at least one artificial RNA of the first aspect and, optionally, the further artificial RNA of the second aspect, is complexed or associated with a polyethylene glycol/peptide polymer comprising HO-PEG5000-S—(S—CGHHHHHRRRRHHHHHGC—S-)4-S-PEG5000-OH (SEQ ID NO: 21320 as peptide monomer).

In other embodiments, the composition comprises at least one artificial RNA as described herein, and, optionally, the further artificial RNA of the second aspect, wherein the at least one artificial RNA and, optionally, the further artificial RNA of the second aspect, is complexed or associated with polymeric carriers and, optionally, with at least one lipid component as described in the published PCT applications WO2017/212008A1, WO2017/212006A1, WO2017/212007A1, and WO2017/212009A1. In this context, the disclosures of WO2017/212008A1, WO2017/212006A1, WO2017/212007A1, and WO2017/212009A1 are herewith incorporated by reference.

In a particularly preferred embodiment, the polymeric carrier is a peptide polymer, preferably a polyethylene glycol/peptide polymer as defined above, and a lipid component, preferably a lipidoid component, more preferably lipidoid component.

In preferred embodiment of the second aspect, the at least one artificial RNA of the first aspect and, optionally, the further artificial RNA of the second aspect, is complexed or associated with a polymeric carrier, preferably with a polyethylene glycol/peptide polymer as defined above, and a lipidoid component, wherein the lipidoid component is a compound according to formula A

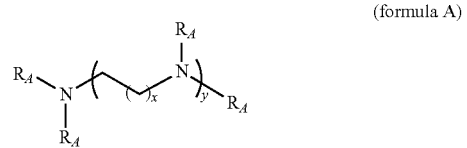

(formula A)

wherein
R$_A$ is independently selected for each occurrence an unsubstituted, cyclic or acyclic, branched or unbranched C$_{1-20}$ aliphatic group; a substituted or unsubstituted, cyclic or acyclic, branched or unbranched C$_{1-20}$ heteroaliphatic group; a substituted or unsubstituted aryl; a substituted or unsubstituted heteroaryl;

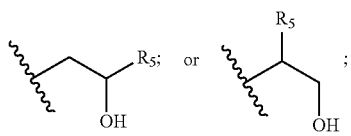

wherein at least one R$_A$ is

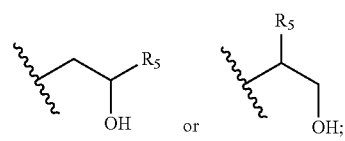

R$_5$ is independently selected for each occurrence of from an unsubstituted, cyclic or acyclic, branched or unbranched C$_{8-16}$ aliphatic; a substituted or unsubstituted aryl; or a substituted or unsubstituted heteroaryl;

each occurrence of x is an integer from 1 to 10;
each occurrence of y is an integer from 1 to 10;
or a pharmaceutically acceptable salt thereof.

In a preferred embodiment, the lipidoid component is 3-C12-OH according to formula B (formula B)

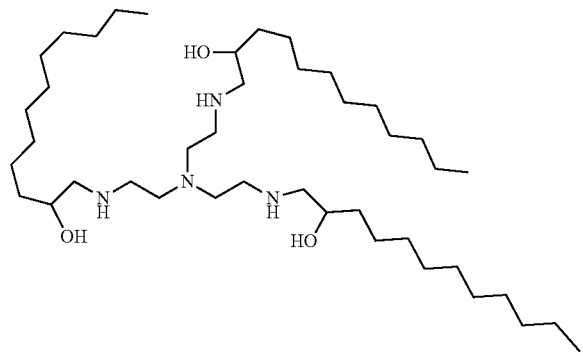

In preferred embodiments, the peptide polymer comprising lipidoid 3-C12-OH as specified above is used to complex the RNA of the first aspect and, optionally, the further artificial RNA of the second aspect, to form complexes having an N/P ratio from about 0.1 to about 20, or from about 0.2 to about 15, or from about 2 to about 15, or from about 2 to about 12, wherein the N/P ratio is defined as the mole ratio of the nitrogen atoms of the basic groups of the cationic peptide or polymer to the phosphate groups of the artificial nucleic acid. In that context, the disclosure of WO2017/212009A1, in particular Claims 1 to 10 of WO2017/212009A1, and the specific disclosure relating thereto is herewith incorporated by reference.

Encapsulation/Complexation in LNPs:

In preferred embodiments of the second aspect, the artificial RNA of the first aspect and, optionally, the further artificial RNA of the second aspect, is complexed or associated with one or more lipids (e.g. cationic lipids and/or neutral lipids), thereby forming liposomes, lipid nanoparticles (LNPs), lipoplexes, and/or nanoliposomes.

For compositions comprising more than one artificial RNA construct as defined herein (e.g. F-del and M2-1), said constructs may be co-formulated in e.g. LNPs to form the respective composition.

Alternatively, said more than one artificial RNA constructs may be formulated separately, and may subsequently be combined, to form the respective composition.

In this context, the terms "complexed" or "associated" refer to the essentially stable combination of artificial RNA of the first aspect and, optionally, the further artificial RNA of the second aspect, with one or more lipids into larger complexes or assemblies without covalent binding.

The term "lipid nanoparticle", also referred to as "LNP", is not restricted to any particular morphology, and include any morphology generated when a cationic lipid and optionally one or more further lipids are combined, e.g. in an aqueous environment and/or in the presence of RNA. For example, a liposome, a lipid complex, a lipoplex and the like are within the scope of a lipid nanoparticle (LNP).

Accordingly, in preferred embodiments of the second aspect, the artificial RNA of the first aspect and, optionally, the further artificial RNA of the second aspect, is complexed with one or more lipids thereby forming lipid nanoparticles (LNP).

LNPs typically comprise a cationic lipid and one or more excipient selected from neutral lipids, charged lipids, steroids and polymer conjugated lipids (e.g. PEGylated lipid). The RNA may be encapsulated in the lipid portion of the LNP or an aqueous space enveloped by some or the entire lipid portion of the LNP. The RNA or a portion thereof may also be associated and complexed with the LNP. An LNP may comprise any lipid capable of forming a particle to which the nucleic acids are attached, or in which the one or more nucleic acids are encapsulated. Preferably, the LNP comprising nucleic acids comprises one or more cationic lipids, and one or more stabilizing lipids. Stabilizing lipids include neutral lipids and PEGylated lipids.

The cationic lipid of an LNP may be cationisable, i.e. it becomes protonated as the pH is lowered below the pK of the ionizable group of the lipid, but is progressively more neutral at higher pH values. At pH values below the pK, the lipid is then able to associate with negatively charged nucleic acids. In certain embodiments, the cationic lipid comprises a zwitterionic lipid that assumes a positive charge on pH decrease.

The LNP may comprise any further cationic or cationisable lipid, i.e. any of a number of lipid species which carry a net positive charge at a selective pH, such as physiological pH.

Such lipids include, but are not limited to, N,N-dioleyl-N,N-dimethylammonium chloride (DODAC), N,N-distearyl-N,N-dimethylammonium bromide (DDAB), 1,2-dioleoyltrimethyl ammonium propane chloride (DOTAP) (also known as N-(2,3-dioleoyloxy)propyl)-N,N,N-trimethylammonium chloride and 1,2-Dioleyloxy-3-trimethylaminopropane chloride salt), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-di-γ-linolenyloxy-N,N-dimethylaminopropane (γ-DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA·Cl), 1,2-Dilinoleoyl-3-trimethylaminopropane chloride salt (DLin-TAP·Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DM A), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine, (6Z,9Z,28Z,31Z)-heptatriaconta-6,9,28,31-tetraen-19-yl-4-(dimethylamino) butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), (6Z,9Z,28Z,31Z)-heptatriaconta-6,9,28,31-tetraen-19-yl 4-(dimethylamino) butanoate (DLin-M-C3-DMA), 3-((6Z,9Z,28Z,31Z)-heptatriaconta-6,9,28,31-tetraen-19-yloxy)-N,N-dimethylpropan-1-amine (MC3 Ether), 4-((6Z,9Z,28Z,31Z)-heptatriaconta-6,9,28,31-tetraen-19-yloxy)-N,N-dimethylbutan-1-amine (MC4 Ether), LIPOFECTIN® (commercially available cationic liposomes comprising DOTMA and 1,2-dioleoyl-sn-3phosphoethanolamine (DOPE), from GIBCO/BRL, Grand Island, N.Y.); LIPOFECTAMINE® (commercially available cationic liposomes comprising N-(1-(2,3dioleyloxy)propyl)-N-(2-(sperminecarboxamido)ethyl)-N,N-dimethylammonium trifluoroacetate (DOSPA) and (DOPE), from GIBCO/BRL); and TRANSFECTAM® (commercially available cationic lipids comprising dioctadecylamidoglycyl carboxyspermine (DOGS) in ethanol from Promega Corp., Madison, Wis.) or any combination of any of the foregoing.

In some embodiments, the lipid is selected from the group consisting of 98N12-5, C12-200, and ckk-E12.

In one embodiment, the further cationic lipid is an amino lipid.

Representative amino lipids include, but are not limited to, 1,2-dilinoleyoxy-3-(dimethylamino)acetoxypropane (DLin-DAC), 1,2-dilinoleyoxy-3morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3dimethylaminopropane (DLin-2-DMAP), 1,2-dilinoleyloxy-3-trimethylaminopropane chloride salt (DLin-TMA·Cl), 1,2-dilinoleoyl-3-trimethylaminopropane chloride salt (DLin-TAP·Cl), 1,2-dilinoleyloxy-3-(N-methylpiperazino)propane (DLin-MPZ), 3-(N,Ndilinoleylamino)-1,2-propanediol (DLinAP), 3-(N,N-dioleylamino)-1,2-propanediol (DOAP), 1,2-dilinoleyloxo-3-(2-N,N-dimethylamino)ethoxypropane (DLin-EG-DMA), and 2,2-dilinoleyl-4-dimethylaminomethyl-[1,3]-dioxolane (DLin-K-DMA), 2,2-dilinoleyl-4-(2-dimethylaminoethyl)-[l,3]-dioxolane (DLin-KC2-DMA); dilinoleyl-methyl-4-dimethylaminobutyrate (DLin-MC3-DMA); MC3 (US20100324120).

In one embodiment, the artificial RNA of the first aspect and, optionally, the further artificial RNA of the second aspect, may be formulated in an aminoalcohol lipidoid.

Aminoalcohol lipidoids which may be used in the present invention may be prepared by the methods described in U.S. Pat. No. 8,450,298, herein incorporated by reference in its entirety. Suitable (ionizable) lipids can also be the compounds as disclosed in Tables 1, 2 and 3 and as defined in claims 1-24 of WO2017/075531A1, hereby incorporated by reference.

In another embodiment, ionizable lipids can also be the compounds as disclosed in WO2015/074085A1 (i.e. ATX-001 to ATX-032 or the compounds as specified in claims 1-26), U.S. application Ser. Nos. 61/905,724 and 15/614,499 or U.S. Pat. Nos. 9,593,077 and 9,567,296 hereby incorporated by reference in their entirety.

In that context, any lipid derived from generic formula (X1)

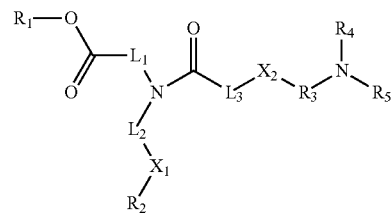

wherein, Ri and R2 are the same or different, each a linear or branched alkyl consisting of 1 to 9 carbons, an alkenyl or alkynyl consisting of 2 to 11 carbons, Li and L2 are the same or different, each a linear alkylene or alkenylene consisting of 5 to 18 carbons, or forming a heterocycle with N, Xi is a bond, or is —CO—O— whereby -L2-CO—O—R2 is formed, X2 is S or O, L3 is a bond or a linear or branched alkylene consisting of 1 to 6 carbons, or forming a heterocycle with N, R3 is a linear or branched alkylene consisting of 1 to 6 carbons, and R4 and R 5 are the same or different, each hydrogen or a linear or branched alkyl consisting of 1 to 6 carbons; or a pharmaceutically acceptable salt thereof may be suitably used.

In other embodiments, suitable cationic lipids can also be the compounds as disclosed in WO2017/117530A1 (i.e. lipids 13, 14, 15, 16, 17, 18, 19, 20, or the compounds as specified in the claims), hereby incorporated by reference in its entirety.

In that context, any lipid derived from generic formula (X2)

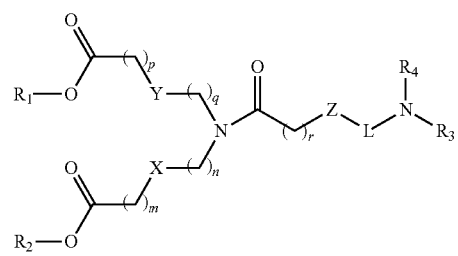

wherein
X is a linear or branched alkylene or alkenylene, monocyclic, bicyclic, or tricyclic arene or heteroarene;
Y is a bond, an ethene, or an unsubstituted or substituted aromatic or heteroaromatic ring; Z is S or O;
L is a linear or branched alkylene of 1 to 6 carbons;
R-3 and R4 are independently a linear or branched alkyl of 1 to 6 carbons;

Ri and R2 are independently a linear or branched alkyl or alkenyl of 1 to 20 carbons; r is 0 to 6; and m, n, p, and q are independently 1 to 18;

wherein when n=q, m=p, and Ri=R2, then X and Y differ;

wherein when X=Y, n=q, m=p, then Ri and R2 differ;

wherein when X=Y, n=q, and Ri=R2, then m and p differ; and wherein when X=Y, m=p, and Ri=R2, then n and q differ;

or a pharmaceutically acceptable salt thereof.

In preferred embodiments, a lipid may be used derived from formula (X2), wherein, X is a bond, linear or branched alkylene, alkenylene, or monocyclic, bicyclic, or tricyclic arene or heteroarene; Y is a monocyclic, bicyclic, or tricyclic arene or heteroarene; Z is S or O; L is a linear or branched alkylene of 1 to 6 carbons; R3 and R4 are independently a linear or branched alkyl of 1 to 6 carbons; Ri and R2 are independently a linear or branched alkyl or alkenyl of 1 to 20 carbons; r is 0 to 6; and m, n, p, and q are independently 1 to 18; or a pharmaceutically acceptable salt thereof may be suitably used.

In preferred embodiments, ionizable lipids may also be selected from the lipid compounds disclosed in PCT application PCT/EP2017/077517 (i.e. lipid compounds derived form formula I, II, and III of PCT/EP2017/077517, or lipid compounds as specified in Claims 1 to 12 of PCT/EP2017/077517), the disclosure of PCT/EP2017/077517 hereby incorporated by reference in its entirety. In that context, lipid compounds disclosed in Table 7 of PCT/EP2017/077517 (e.g. lipid compounds derived from formula I-1 to I-41) and lipid compounds disclosed in Table 8 of PCT/EP2017/077517 (e.g. lipid compounds derived from formula II-1 to II-36) may be suitably used in the context of the invention. Accordingly, formula I-1 to formula I-41 and formula II-1 to formula II-36 of PCT/EP2017/077517, and the specific disclosure relating thereto, are herewith incorporated by reference.

In particularly preferred embodiments of the second aspect, a suitable lipid may be a cationic lipid according to formula (III)

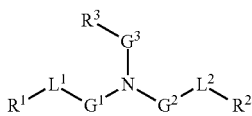

or a pharmaceutically acceptable salt, tautomer, prodrug or stereoisomer thereof, wherein, R1, R2, R3, L1, L2, G1, G2, and G3 are as below.

Formula (III) is further defined in that:

one of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, —NR$^a$C(=O)NR$^a$—, —OC(=O) NR$^a$— or —NR$^a$C(=O)O—, and the other of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, —NR$^a$C(=O) NR$^a$—, —OC(=O)NR$^a$— or —NR$^a$C(=O)O— or a direct bond;

$G^1$ and $G^2$ are each independently unsubstituted $C_1$-$C_{12}$ alkylene or $C_1$-$C_{12}$ alkenylene;

$G^3$ is $C_1$-$C_{24}$ alkylene, $C_1$-$C_{24}$ alkenylene, $C_3$-$C_8$ cycloalkylene, $C_3$-$C_8$ cycloalkenylene;

$R^a$ is H or $C_1$-$C_{12}$ alkyl;

$R^1$ and $R^2$ are each independently $C_6$-$C_{24}$ alkyl or $C_6$-$C_{24}$ alkenyl;

$R^3$ is H, OR$^5$, CN, —C(=O)OR$^4$, —OC(=O)R$^4$ or —NR$^5$C(=O)R$^4$;

$R^4$ is $C_1$-$C_{12}$ alkyl;

$R^5$ is H or $C_1$-$C_6$ alkyl; and x is 0, 1 or 2.

In some of the foregoing embodiments of formula (III), the lipid has one of the following structures (IIIA) or (IIIB):

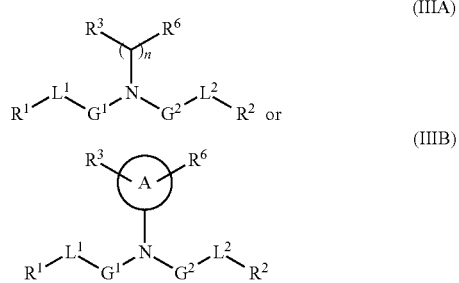

wherein:

A is a 3 to 8-membered cycloalkyl or cycloalkylene ring;

$R^6$ is, at each occurrence, independently H, OH or $C_1$-$C_{24}$ alkyl; n is an integer ranging from 1 to 15.

In some of the foregoing embodiments of formula (III), the lipid has structure (IIIA), and in other embodiments, the lipid has structure (IIIB).

In other embodiments of formula (III), the lipid has one of the following structures (IIIC) or (IIID):

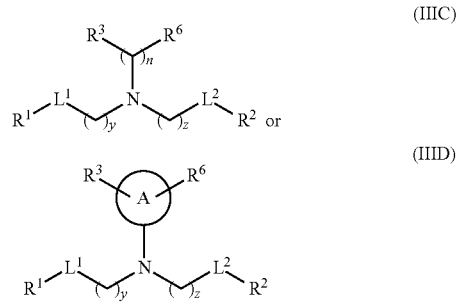

wherein y and z are each independently integers ranging from 1 to 12.

In any of the foregoing embodiments of formula (III), one of $L^1$ or $L^2$ is —O(C=O)—. For example, in some embodiments each of $L^1$ and $L^2$ are —O(C=O)—. In some different embodiments of any of the foregoing, $L^1$ and $L^2$ are each independently —(C=O)O— or —O(C=O)—. For example, in some embodiments each of $L^1$ and $L^2$ is —(C=O)O—.

In preferred embodiments of the second aspect, the cationic lipid of the LNP is a compound of formula III, wherein:

$L^1$ and $L^2$ are each independently —O(C=O)— or (C=O)—O—;

$G^3$ is $C_1$-$C_{24}$ alkylene or $C_1$-$C_{24}$ alkenylene; and $R^3$ is H or OR$^5$.

In some different embodiments of formula (III), the lipid has one of the following structures (IIIE) or (IIIF):

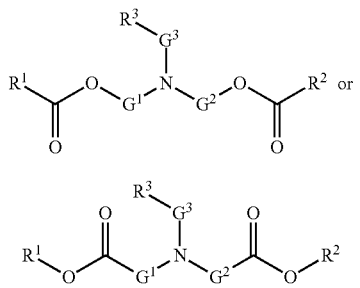

In some of the foregoing embodiments of formula (III), the lipid has one of the following structures (IIIG), (IIIH), (IIII), or (IIIJ):

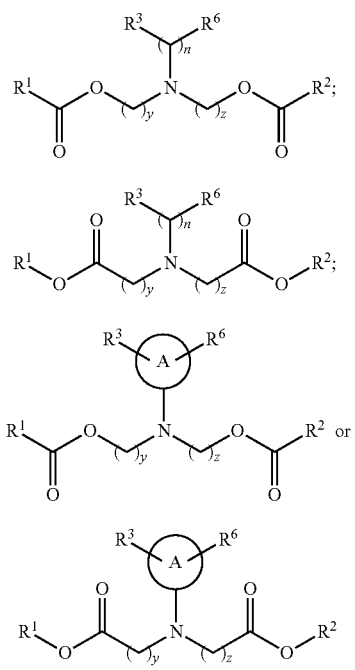

In some of the foregoing embodiments of formula (III), n is an integer ranging from 2 to 12, for example from 2 to 8 or from 2 to 4. In some embodiments, n is 3, 4, 5 or 6. In some embodiments, n is 3. In some embodiments, n is 4. In some embodiments, n is 5. In some embodiments, n is 6. In some other of the foregoing embodiments of formula (III), y and z are each independently an integer ranging from 2 to 10. For example, in some embodiments, y and z are each independently an integer ranging from 4 to 9 or from 4 to 6. In some of the foregoing embodiments of formula (III), $R^6$ is H. In other of the foregoing embodiments, $R^6$ is $C_1$-$C_{24}$ alkyl. In other embodiments, $R^6$ is OH. In some embodiments of formula (III), $G^3$ is unsubstituted. In other embodiments, G3 is substituted. In various different embodiments, $G^3$ is linear $C_1$-$C_{24}$ alkylene or linear $C_1$-$C_{24}$ alkenylene. In some other foregoing embodiments of formula (III), $R^1$ or $R^2$, or both, is $C_6$-$C_{24}$ alkenyl. For example, in some embodiments, $R^1$ and $R^2$ each, independently have the following structure:

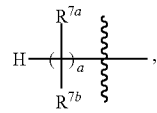

wherein:

$R^{7a}$ and $R^{7b}$ are, at each occurrence, independently H or $C_1$-$C_{12}$ alkyl; and a is an integer from 2 to 12, wherein $R^{7a}$, $R^{7b}$ and a are each selected such that $R^1$ and $R^2$ each independently comprise from 6 to 20 carbon atoms. For example, in some embodiments a is an integer ranging from 5 to 9 or from 8 to 12. In some of the foregoing embodiments of formula (III), at least one occurrence of $R^{7a}$ is H. For example, in some embodiments, $R^{7a}$ is H at each occurrence. In other different embodiments of the foregoing, at least one occurrence of $R^{7b}$ is $C_1$-$C_8$ alkyl. For example, in some embodiments, $C_1$-$C_8$ alkyl is methyl, ethyl, n-propyl, iso-propyl, n-butyl, iso-butyl, tert-butyl, n-hexyl or n-octyl.

In different embodiments of formula (III), $R^1$ or $R^2$, or both, has one of the following structures:

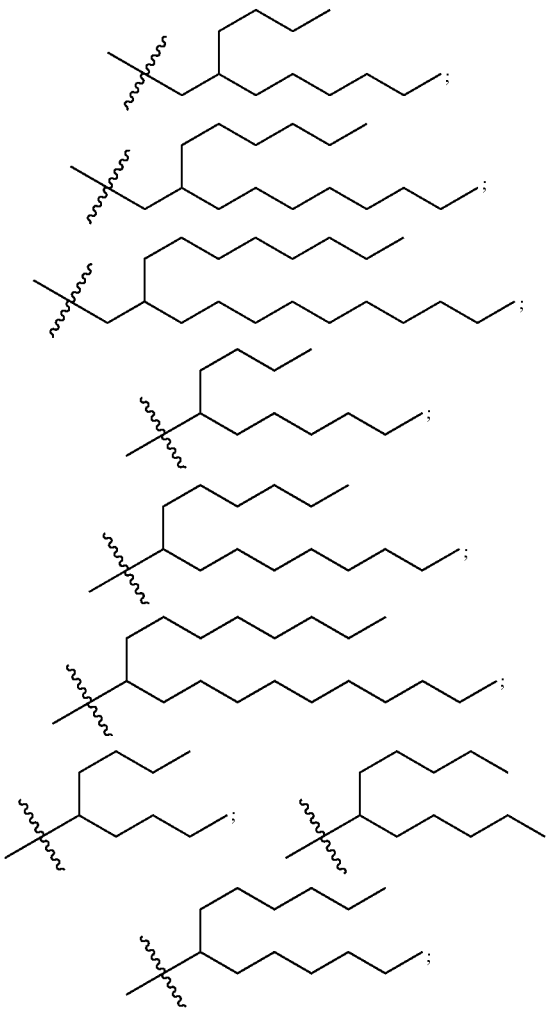

-continued

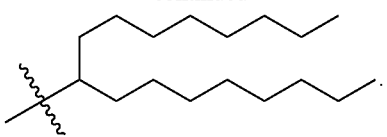

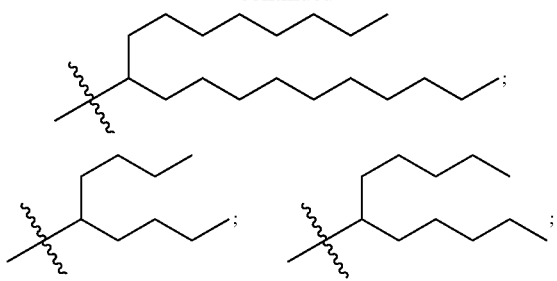

In preferred embodiments of the second aspect, the cationic lipid of the LNP is a compound of formula III, wherein:

L$^1$ and L$^2$ are each independently —O(C=O)— or (C=O)—O—; and

R$^1$ and R$^2$ each independently have one of the following structures:

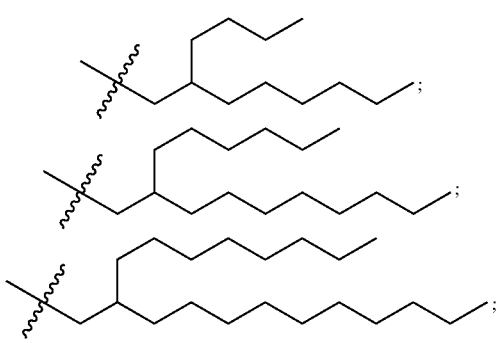

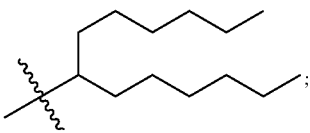

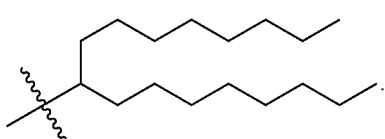

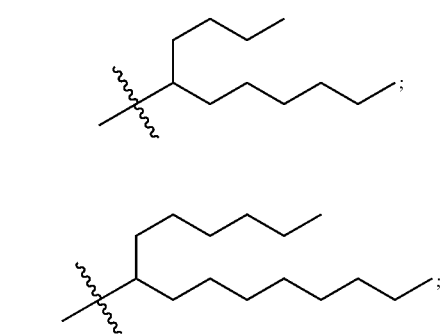

In some of the foregoing embodiments of formula (III), R$^3$ is OH, CN, —C(=O)OR$^4$, —OC(=O)R$^4$ or —NHC(=O)R$^4$. In some embodiments, R$^4$ is methyl or ethyl.

In preferred embodiments of the second aspect, the cationic lipid of the LNP is a compound of formula III, wherein R$^3$ is OH.

In particularly preferred embodiment of the second aspect, the artificial RNA of the first aspect and, optionally, the further artificial RNA of the second aspect, is complexed with one or more lipids thereby forming lipid nanoparticles (LNP), wherein the LNP is selected from structures III-1 to III-36 (see Table 8).

TABLE 8

Representative lipid compounds derived from formula (III)

| No. | Structure |
|---|---|
| III-1 | 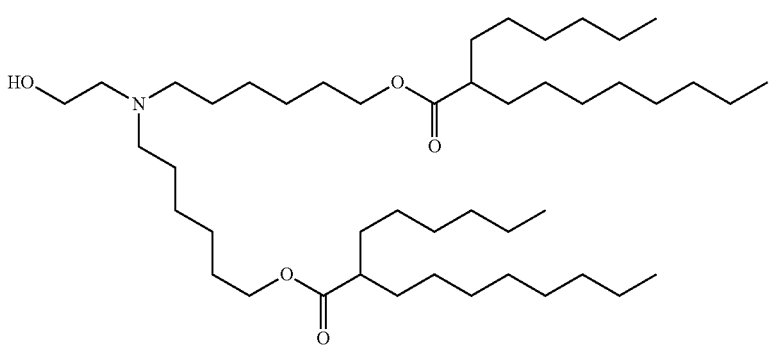 [SMILES: CCCCCCCCC(CCCCCC)C(=O)OCCCCCCN(CCO)CCCCCCOC(=O)C(CCCCCC)CCCCCCCC] |

TABLE 8-continued
Representative lipid compounds derived from formula (III)
| No. | Structure |
|---|---|
| III-2 | 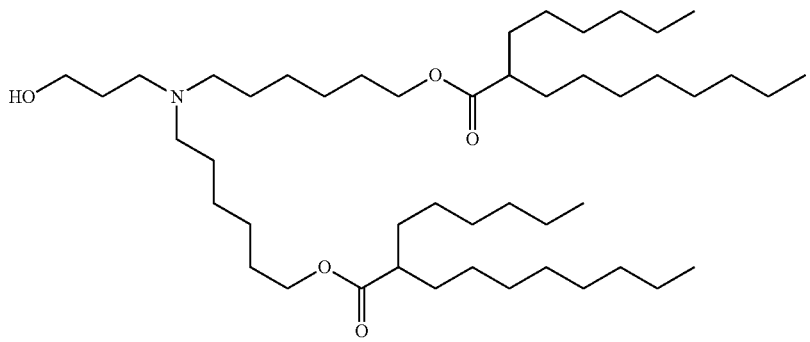 [SMILES: CCCCCCCCC(CCCCCC)C(=O)OCCCCCCN(CCCO)CCCCCCOC(=O)C(CCCCCC)CCCCCCCC] |
| III-3 | 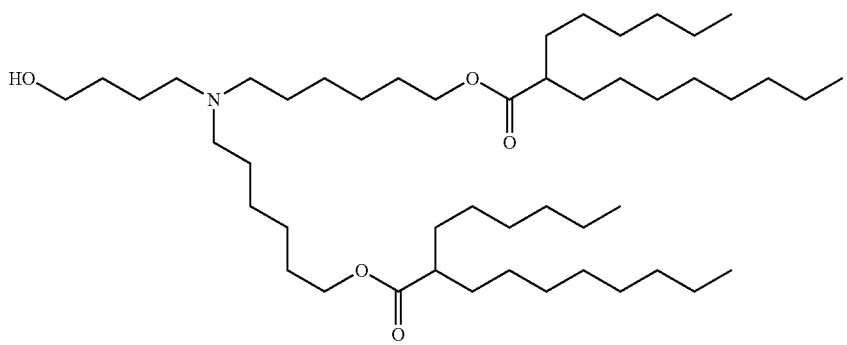 [SMILES: CCCCCCCCC(CCCCCC)C(=O)OCCCCCCN(CCCCO)CCCCCCOC(=O)C(CCCCCC)CCCCCCCC] |
| III-4 | 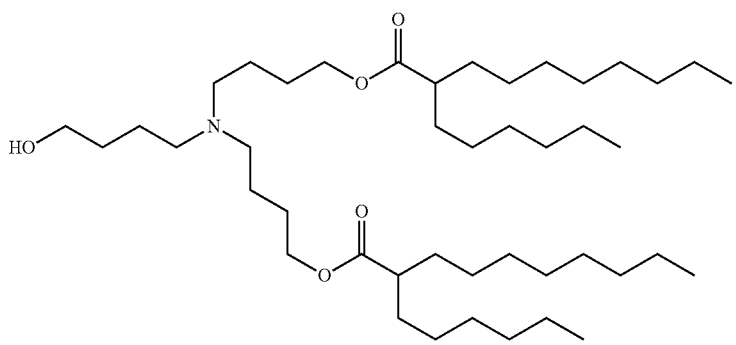 [SMILES: CCCCCCCCC(CCCCCC)C(=O)OCCCCN(CCCCO)CCCCOC(=O)C(CCCCCC)CCCCCCCC] |
| III-5 | 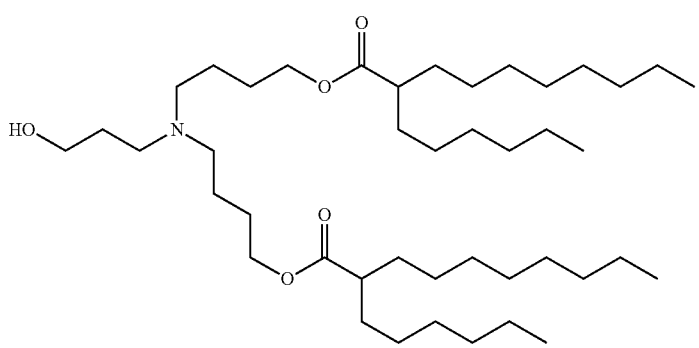 [SMILES: CCCCCCCCC(CCCCCC)C(=O)OCCCCN(CCCO)CCCCOC(=O)C(CCCCCC)CCCCCCCC] |

TABLE 8-continued
Representative lipid compounds derived from formula (III)
| No. | Structure |
|---|---|
| III-6 | 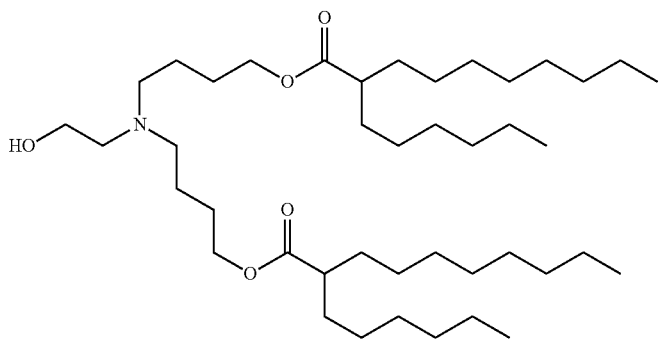 [SMILES: CCCCCCCCC(CCCCCC)C(=O)OCCCCN(CCO)CCCCOC(=O)C(CCCCCC)CCCCCCCC] |
| III-7 | 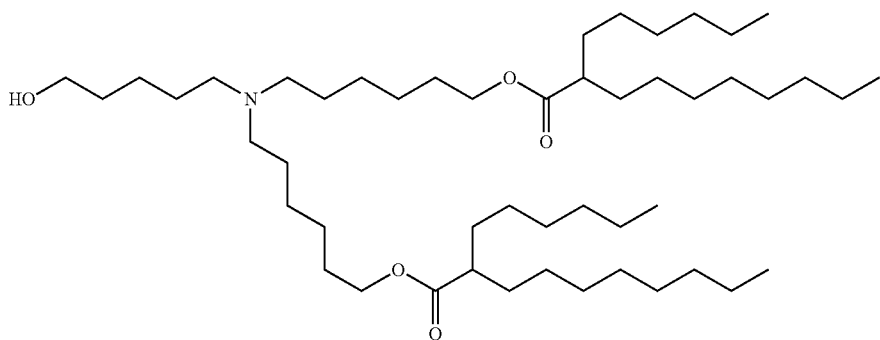 [SMILES: CCCCCCCCC(CCCCCC)C(=O)OCCCCCCN(CCCCCO)CCCCCCOC(=O)C(CCCCCC)CCCCCCCC] |
| III-8 | 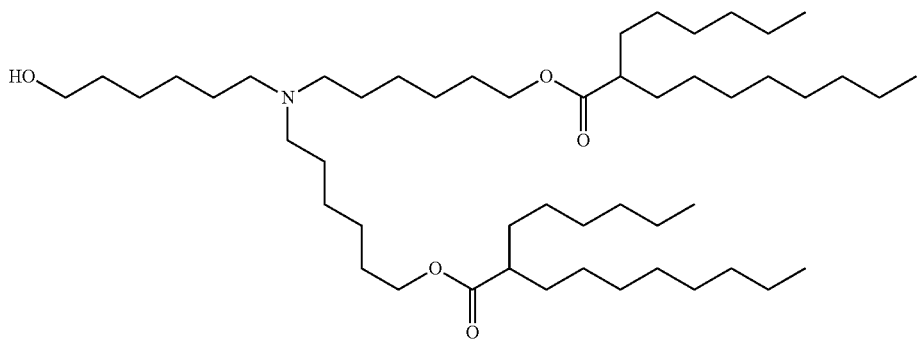 [SMILES: CCCCCCCCC(CCCCCC)C(=O)OCCCCCCN(CCCCCCO)CCCCCCOC(=O)C(CCCCCC)CCCCCCCC] |
| III-9 | 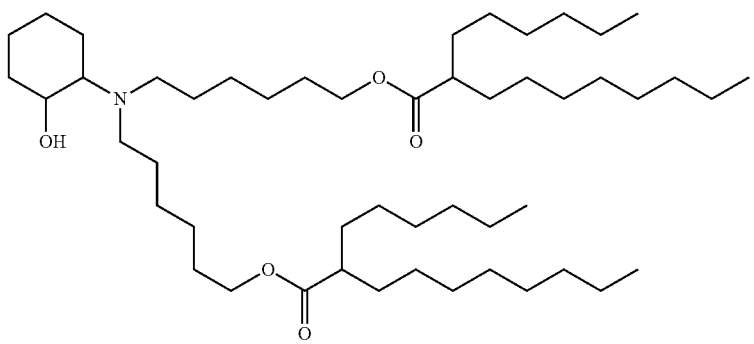 [SMILES: CCCCCCCCC(CCCCCC)C(=O)OCCCCCCN(CCCCCCOC(=O)C(CCCCCC)CCCCCCCC)C1CCCCC1O] |

TABLE 8-continued
Representative lipid compounds derived from formula (III)
| No. | Structure |
|---|---|
| III-10 | 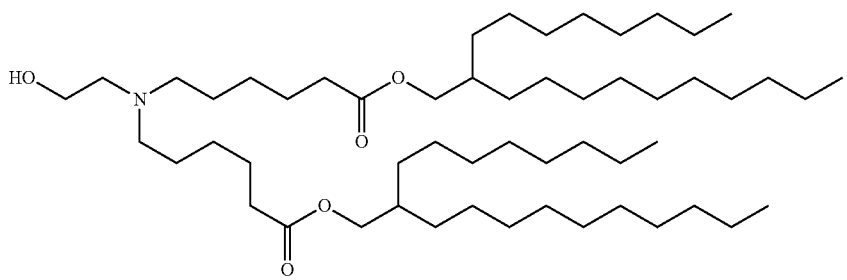 [SMILES: CCCCCCCCCCC(CCCCCCCC)COC(=O)CCCCCN(CCO)CCCCCC(=O)OCC(CCCCCCCC)CCCCCCCCCC] |
| III-11 | 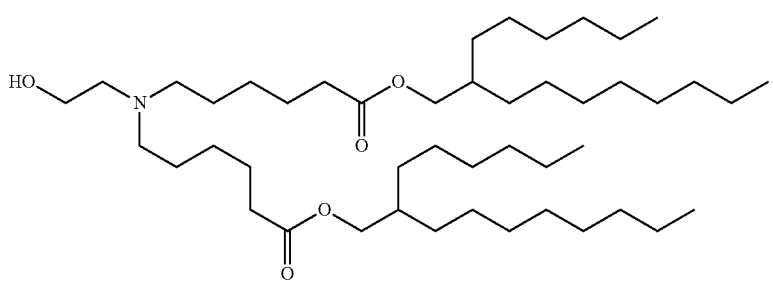 [SMILES: CCCCCCCCC(CCCCCC)COC(=O)CCCCCN(CCO)CCCCCC(=O)OCC(CCCCCC)CCCCCCCC] |
| III-12 | 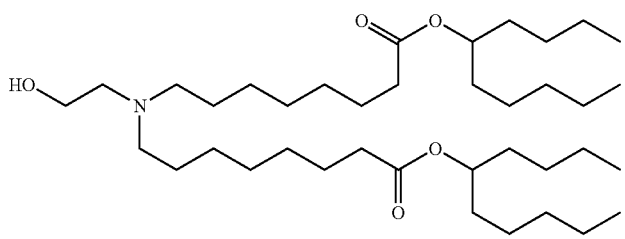 [SMILES: CCCCCC(CCCC)OC(=O)CCCCCCCN(CCO)CCCCCCCC(=O)OC(CCCC)CCCCC] |
| III-13 | 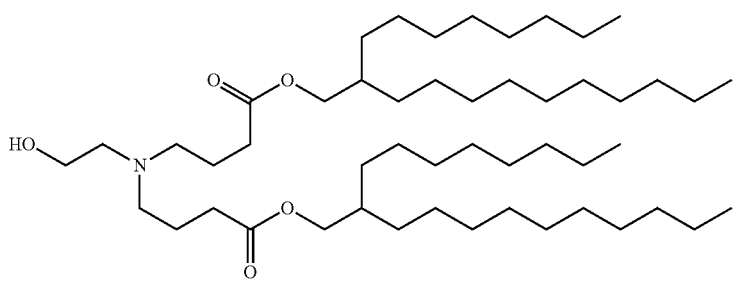 [SMILES: CCCCCCCCCCC(CCCCCCCC)COC(=O)CCCN(CCO)CCCC(=O)OCC(CCCCCCCC)CCCCCCCCCC] |
| III-14 | 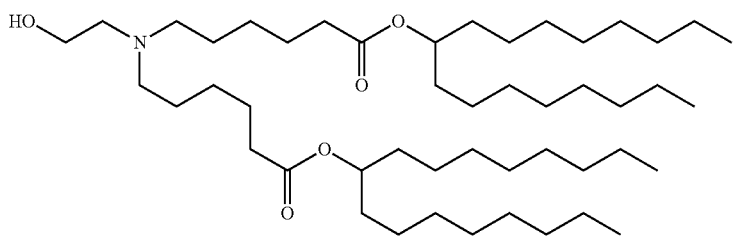 [SMILES: CCCCCCCCC(CCCCCCCC)OC(=O)CCCCCN(CCO)CCCCCC(=O)OC(CCCCCCCC)CCCCCCCC] |

TABLE 8-continued
Representative lipid compounds derived from formula (III)
| No. | Structure |
|---|---|
| III-15 | 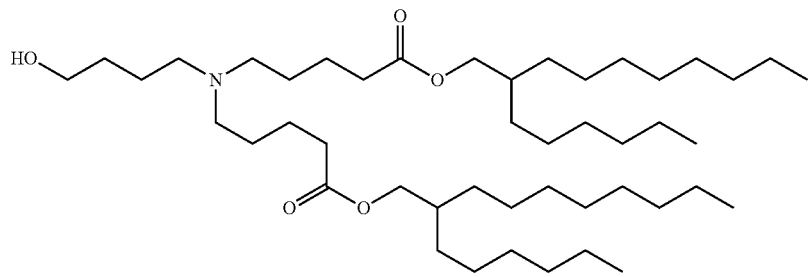 [SMILES: CCCCCCCCC(CCCCCC)COC(=O)CCCCN(CCCCO)CCCCC(=O)OCC(CCCCCC)CCCCCCCC] |
| III-16 | 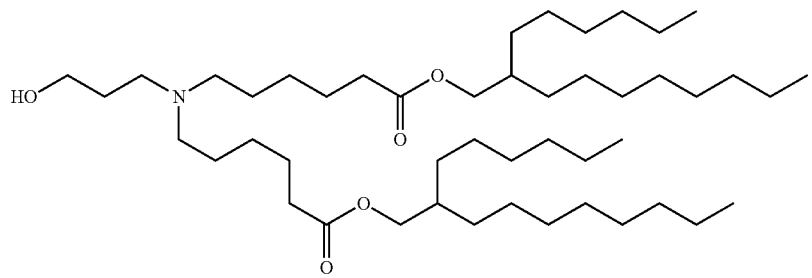 [SMILES: CCCCCCCCC(CCCCCC)COC(=O)CCCCCN(CCCO)CCCCCC(=O)OCC(CCCCCC)CCCCCCCC] |
| III-17 | 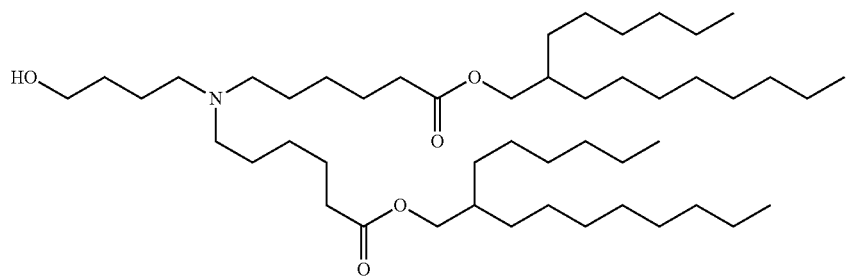 [SMILES: CCCCCCCCC(CCCCCC)COC(=O)CCCCCN(CCCCO)CCCCCC(=O)OCC(CCCCCC)CCCCCCCC] |
| III-18 | 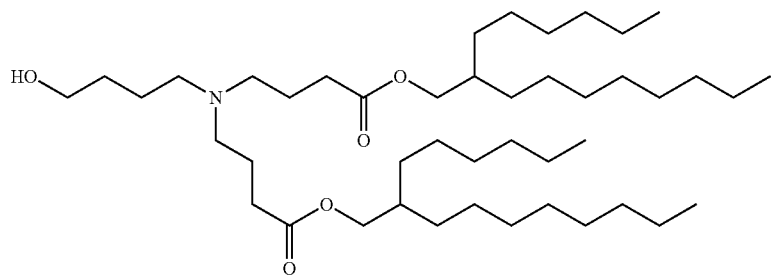 [SMILES: CCCCCCCCC(CCCCCC)COC(=O)CCCN(CCCCO)CCCC(=O)OCC(CCCCCC)CCCCCCCC] |
| III-19 | 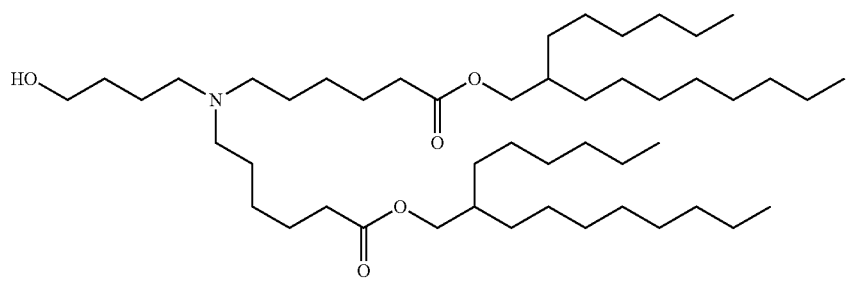 [SMILES: CCCCCCCCC(CCCCCC)COC(=O)CCCCCN(CCCCO)CCCCCC(=O)OCC(CCCCCC)CCCCCCCC] |

TABLE 8-continued
Representative lipid compounds derived from formula (III)
| No. | Structure |
|---|---|
| III-20 | 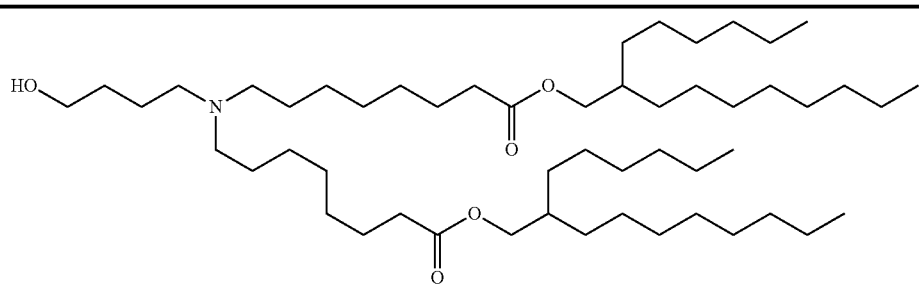 |
| III-21 | 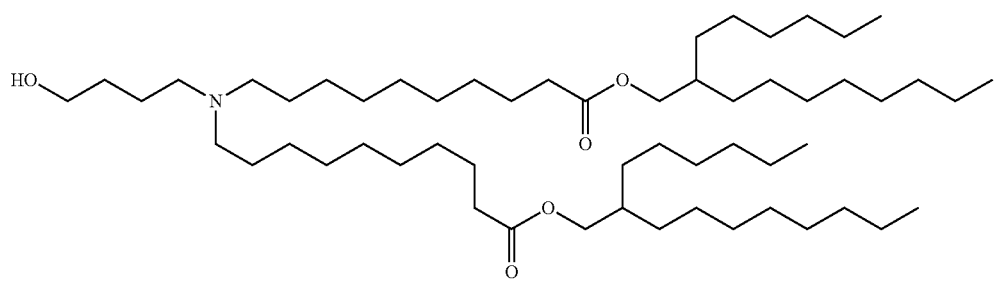 [SMILES: CCCCCCCCC(CCCCCC)COC(=O)CCCCCCCCCN(CCCCO)CCCCCCCCCC(=O)OCC(CCCCCC)CCCCCCCC] |
| III-22 | 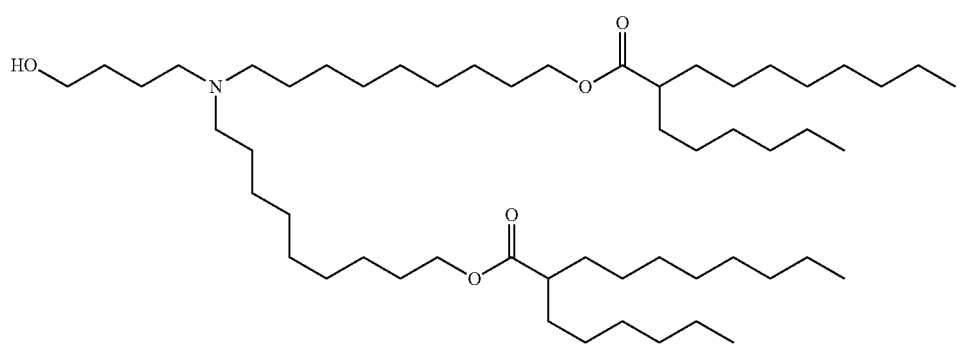 [SMILES: CCCCCCCCC(CCCCCC)C(=O)OCCCCCCCCCN(CCCCO)CCCCCCCCCOC(=O)C(CCCCCC)CCCCCCCC] |
| III-23 | 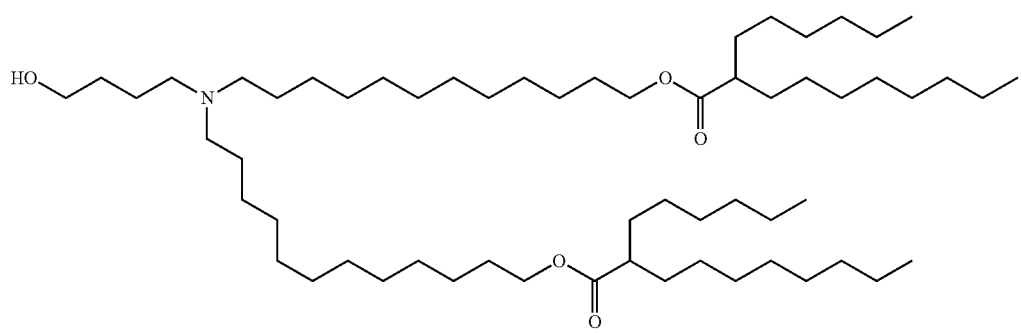 [SMILES: CCCCCCCCC(CCCCCC)C(=O)OCCCCCCCCCCCCN(CCCCO)CCCCCCCCCCCCOC(=O)C(CCCCCC)CCCCCCCC] |
| III-24 | 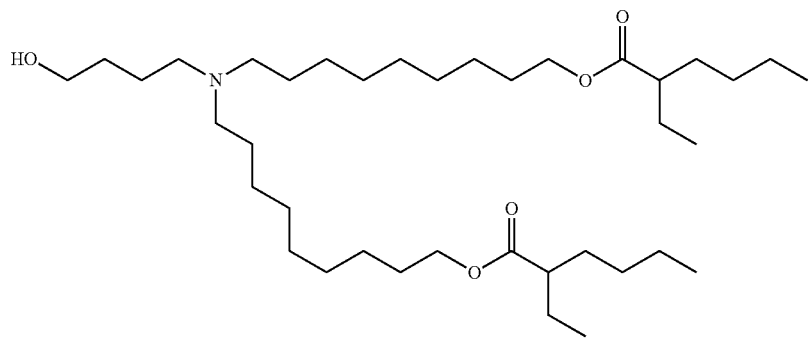 [SMILES: CCCCC(CC)C(=O)OCCCCCCCCCN(CCCCO)CCCCCCCCCOC(=O)C(CC)CCCC] |

TABLE 8-continued
Representative lipid compounds derived from formula (III)
| No. | Structure |
|---|---|
III-25
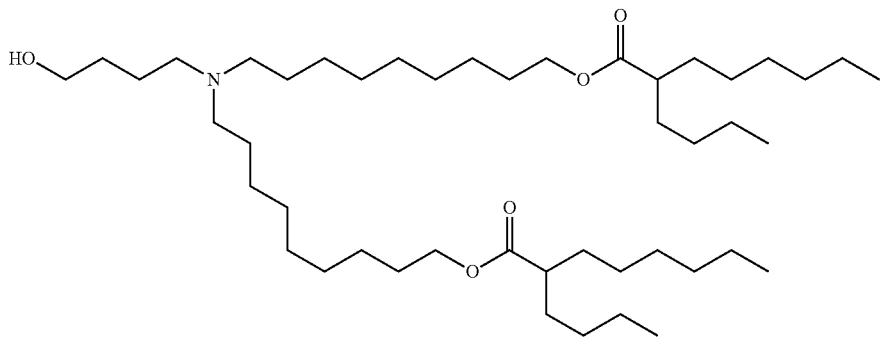 [SMILES: CCCCCCC(CCCC)C(=O)OCCCCCCCCCN(CCCCO)CCCCCCCCCOC(=O)C(CCCC)CCCCCC]
III-26
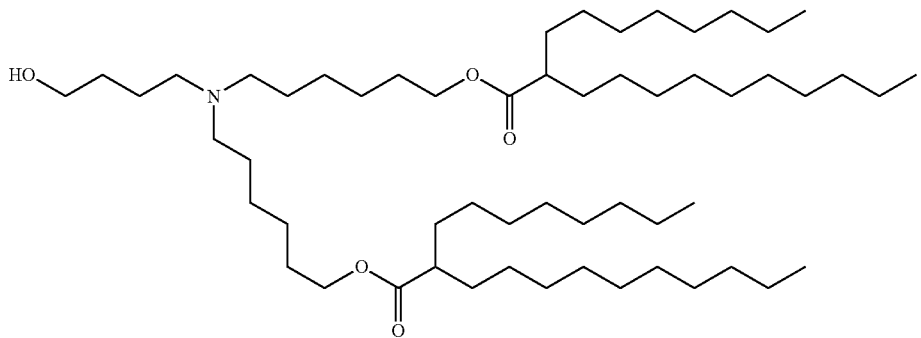 [SMILES: CCCCCCCCCCC(CCCCCCCC)C(=O)OCCCCCCN(CCCCO)CCCCCCOC(=O)C(CCCCCCCC)CCCCCCCCCC]
III-27
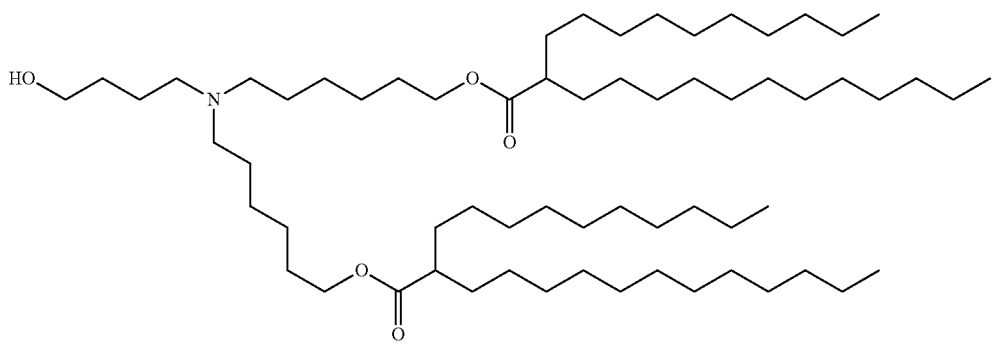 [SMILES: CCCCCCCCCCCCC(CCCCCCCCCC)C(=O)OCCCCCCN(CCCCO)CCCCCCOC(=O)C(CCCCCCCCCC)CCCCCCCCCCCC]
III-28
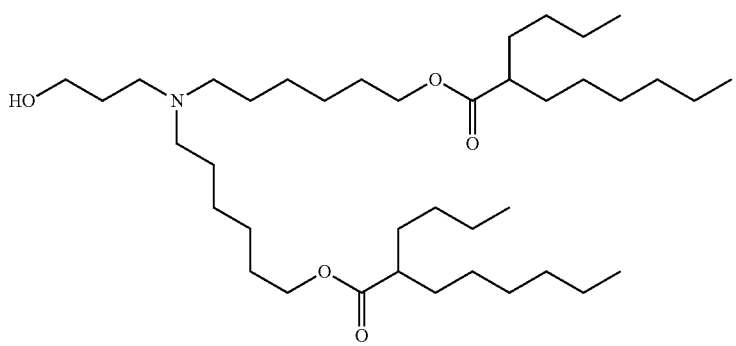 [SMILES: CCCCCCC(CCCC)C(=O)OCCCCCCN(CCCO)CCCCCCOC(=O)C(CCCC)CCCCCC]

TABLE 8-continued
Representative lipid compounds derived from formula (III)
| No. | Structure |
|---|---|
| III-29 | 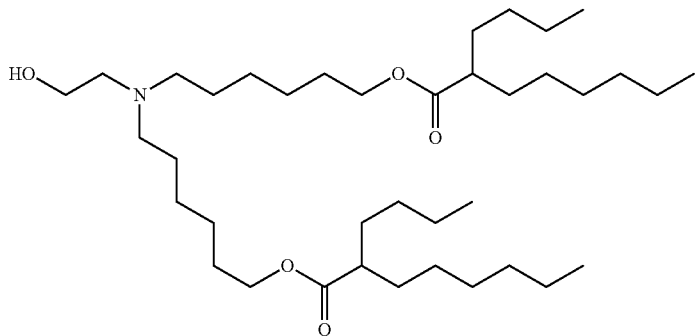 [SMILES: CCCCCCC(CCCC)C(=O)OCCCCCCN(CCO)CCCCCCOC(=O)C(CCCC)CCCCCC] |
| III-30 | 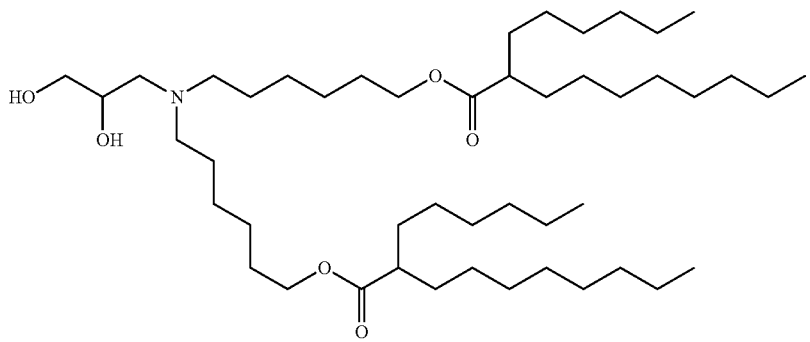 [SMILES: CCCCCCCCC(CCCCCC)C(=O)OCCCCCCN(CCCCCCOC(=O)C(CCCCCC)CCCCCCCC)CC(O)CO] |
| III-31 | 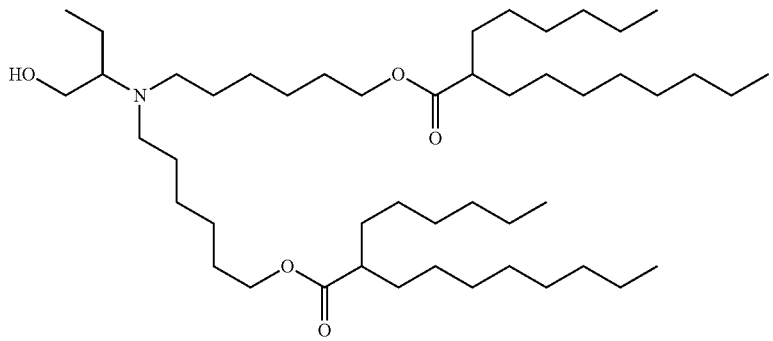 [SMILES: CCCCCCCCC(CCCCCC)C(=O)OCCCCCCN(CCCCCCOC(=O)C(CCCCCC)CCCCCCCC)C(CC)CO] |
| III-32 | 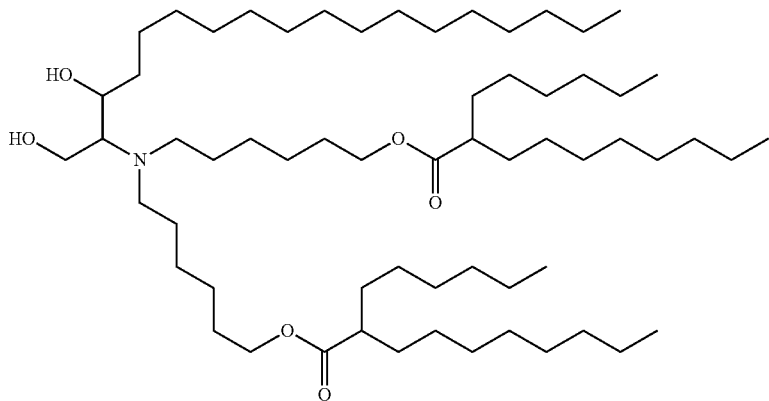 [SMILES: CCCCCCCCCCCCCCCC(O)C(CO)N(CCCCCCOC(=O)C(CCCCCC)CCCCCCCC)CCCCCCOC(=O)C(CCCCCC)CCCCCCCC] |

TABLE 8-continued
Representative lipid compounds derived from formula (III)
| No. | Structure |
|---|---|
| III-33 | 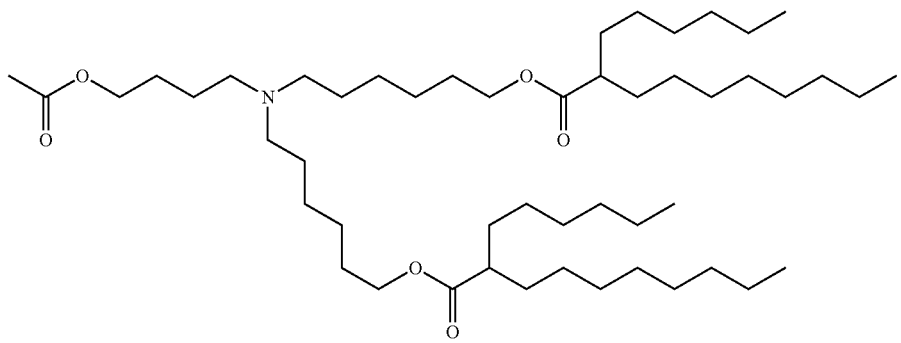 [SMILES: CCCCCCCCC(CCCCCC)C(=O)OCCCCCCN(CCCCCCOC(=O)C(CCCCCC)CCCCCCCC)CCCCOC(C)=O] |
| III-34 | 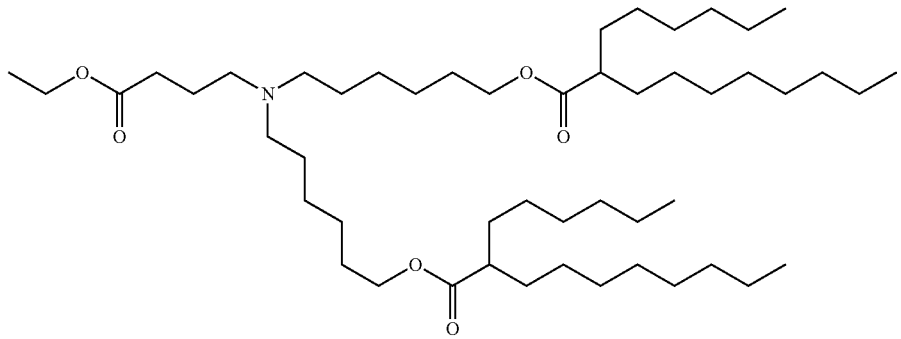 [SMILES: CCCCCCCCC(CCCCCC)C(=O)OCCCCCCN(CCCCCCOC(=O)C(CCCCCC)CCCCCCCC)CCCC(=O)OCC] |
| III-35 | 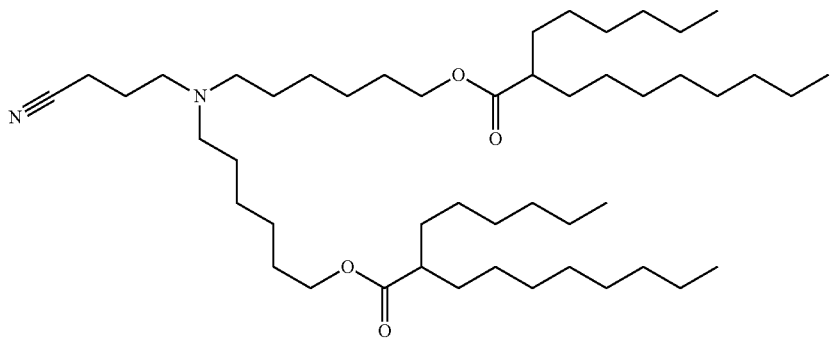 [SMILES: CCCCCCCCC(CCCCCC)C(=O)OCCCCCCN(CCCC#N)CCCCCCOC(=O)C(CCCCCC)CCCCCCCC] |
| III-36 | 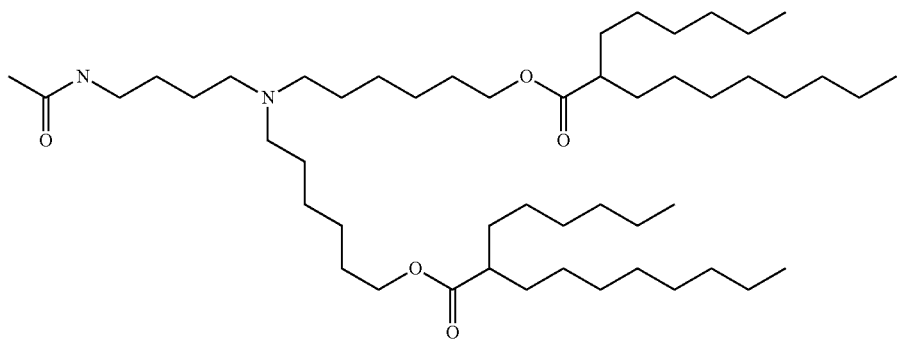 |

In some embodiments, the LNPs comprise a lipid of formula (III), an artificial RNA of the first aspect, and, optionally, the further artificial RNA of the second aspect, and one or more excipient selected from neutral lipids, steroids and PEGylated lipids. In some embodiments the lipid of formula (III) is compound III-3. In some embodiments the lipid of formula (III) is compound III-7.

In preferred embodiments, the LNP comprises a cationic lipid selected from:

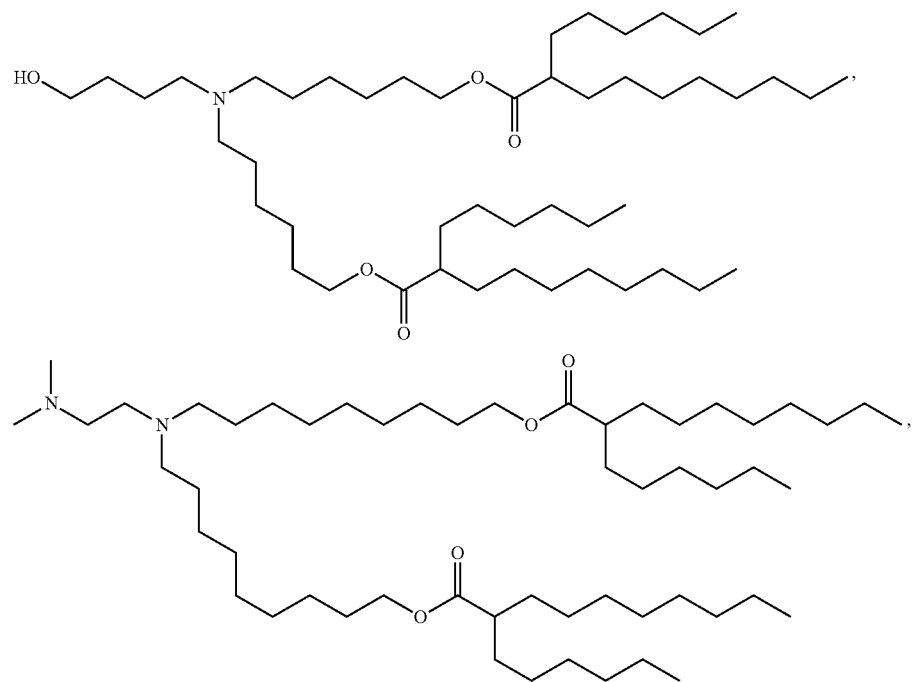

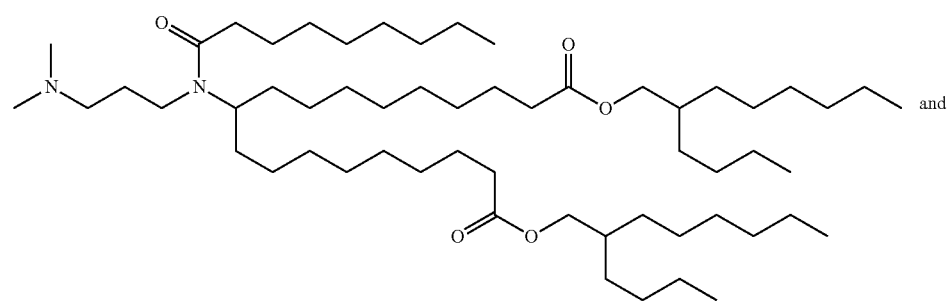

and

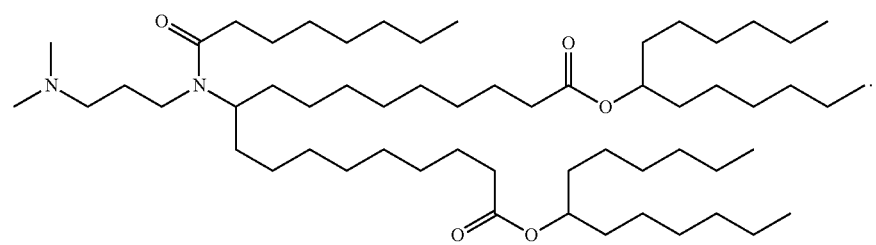

In particularly preferred embodiment of the second aspect, the artificial RNA of the first aspect and, optionally, the further artificial RNA of the second aspect, is complexed with one or more lipids thereby forming lipid nanoparticles (LNP), wherein the LNP comprises the following cationic lipid (lipid according to formula III-3 of Table 8):

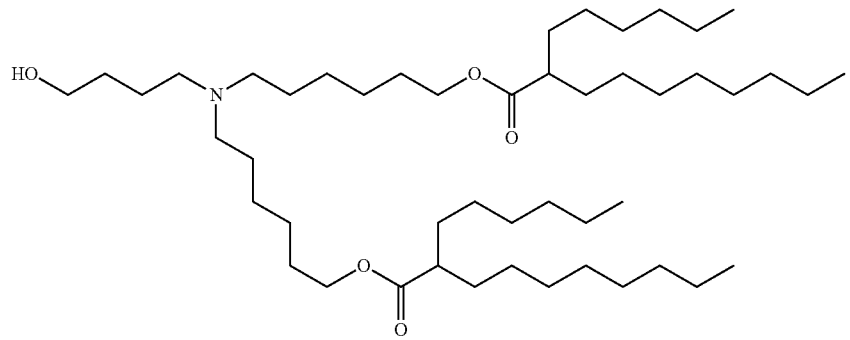 [SMILES: CCCCCCCCC(CCCCCC)C(=O)OCCCCCCN(CCCCO)CCCCCCOC(=O)C(CCCCCC)CCCCCCCC]

In certain embodiments, the cationic lipid as defined herein, preferably as disclosed in Table 8, more preferably cationic lipid compound III-3, is present in the LNP in an amount from about 30 to about 95 mole percent, relative to the total lipid content of the LNP. If more than one cationic lipid is incorporated within the LNP, such percentages apply to the combined cationic lipids.

In one embodiment, the cationic lipid is present in the LNP in an amount from about 30 to about 70 mole percent. In one embodiment, the cationic lipid is present in the LNP in an amount from about 40 to about 60 mole percent, such as about 40, 41, 42, 43, 44, 45, 46, 47, 48, 49, 50, 51, 52, 53, 54, 55, 56, 57, 58, 59 or 60 mole percent, respectively. In embodiments, the cationic lipid is present in the LNP in an amount from about 47 to about 48 mole percent, such as about 47.0, 47.1, 47.2, 47.3, 47.4, 47.5, 47.6, 47.7, 47.8, 47.9, 50.0 mole percent, respectively, wherein 47.7 mole percent are particularly preferred.

In some embodiments, the cationic lipid is present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. In further embodiments, the LNPs comprise from about 25% to about 75% on a molar basis of cationic lipid, e.g., from about 20 to about 70%, from about 35 to about 65%, from about 45 to about 65%, about 60%, about 57.5%, about 57.1%, about 50% or about 40% on a molar basis (based upon 100% total moles of lipid in the lipid nanoparticle). In some embodiments, the ratio of cationic lipid to nucleic acid, preferably to the artificial RNA of the first aspect, and, optionally, the further artificial RNA of the second aspect, is from about 3 to about 15, such as from about 5 to about 13 or from about 7 to about 11.

In some embodiments of the invention the LNP comprises a combination or mixture of any the lipids described above.

Other suitable (cationic) lipids are disclosed in WO2009/086558, WO2009/127060, WO2010/048536, WO2010/054406, WO2010/088537, WO2010/129709, WO2011/153493, US2011/0256175, US2012/0128760, US2012/0027803, U.S. Pat. No. 8,158,601, WO2016/118724, WO2016/118725, WO2017/070613, WO2017/070620, WO2017/099823, and WO2017/112865. In that context, the disclosures of WO2009/086558, WO2009/127060, WO2010/048536, WO2010/054406, WO2010/088537, WO2010/129709, WO2011/153493, US2011/0256175, US2012/0128760, US2012/0027803, U.S. Pat. No. 8,158,601, WO2016/118724, WO2016/118725, WO2017/070613, WO2017/070620, WO2017/099823, and WO2017/112865 specifically relating to (cationic) lipids suitable for LNPs are incorporated herewith by reference.

In some embodiments, the lipid is selected from the group consisting of 98N12-5, C12-200, and ckk-E12.

In some embodiments, amino or cationic lipids as defined herein have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of lipids have to be present in the charged or neutral form. Lipids having more than one protonatable or deprotonatable group, or which are zwitterionic, are not excluded and may likewise suitable in the context of the present invention.

In some embodiments, the protonatable lipids have a pKa of the protonatable group in the range of about 4 to about 11, e.g., a pKa of about 5 to about 7.

LNPs can comprise two or more (different) cationic lipids. The cationic lipids may be selected to contribute different advantageous properties. For example, cationic lipids that differ in properties such as amine pKa, chemical stability, half-life in circulation, half-life in tissue, net accumulation in tissue, or toxicity can be used in the LNP. In particular, the cationic lipids can be chosen so that the properties of the mixed-LNP are more desirable than the properties of a single-LNP of individual lipids.

The amount of the permanently cationic lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the RNA which is used as cargo. The N/P ratio may be calculated on the basis that, for example, 1 µg RNA typically contains about 3 nmol phosphate residues, provided that the RNA exhibits a statistical distribution of bases. The "N"-value of the lipid or lipidoid may be calculated on the basis of its molecular weight and the relative content of permanently cationic and—if present—cationisable groups.

LNP in vivo characteristics and behavior can be modified by addition of a hydrophilic polymer coating, e.g. polyethylene glycol (PEG), to the LNP surface to confer steric stabilization. Furthermore, LNPs can be used for specific targeting by attaching ligands (e.g. antibodies, peptides, and carbohydrates) to its surface or to the terminal end of the attached PEG chains (e.g. via PEGylated lipids).

In some embodiments, the LNPs comprise a polymer conjugated lipid. The term "polymer conjugated lipid" refers to a molecule comprising both a lipid portion and a polymer portion. An example of a polymer conjugated lipid is a PEGylated lipid. The term "PEGylated lipid" refers to a molecule comprising both a lipid portion and a polyethylene glycol portion. PEGylated lipids are known in the art and include 1-(monomethoxy-polyethyleneglycol)-2,3-dimyristoylglycerol (PEG-s-DMG) and the like.

In certain embodiments, the LNP comprises an additional, stabilizing-lipid which is a polyethylene glycol-lipid (PEGylated lipid). Suitable polyethylene glycol-lipids include PEG-modified phosphatidylethanolamine, PEG-modified phosphatidic acid, PEG-modified ceramides (e.g. PEG-CerC14 or PEG-CerC20), PEG-modified dialkylamines, PEG-modified diacylglycerols, PEG-modified dialkylglycerols. Representative polyethylene glycol-lipids include PEG-c-DOMG, PEG-c-DMA, and PEG-s-DMG. In one embodiment, the polyethylene glycol-lipid is N-[(methoxy poly(ethylene glycol)2000)carbamyl]-1,2-dimyristyloxlpropyl-3-amine (PEG-c-DMA). In a preferred embodiment, the polyethylene glycol-lipid is PEG-2000-DMG. In one embodiment, the polyethylene glycol-lipid is PEG-c-DOMG). In other embodiments, the LNPs comprise a PEGylated diacylglycerol (PEG-DAG) such as 1-(monomethoxy-polyethyleneglycol)-2,3-dimyristoylglycerol (PEG-DMG), a PEGylated phosphatidylethanoloamine (PEG-PE), a PEG succinate diacylglycerol (PEG-S-DAG) such as 4-O-(2',3'-di(tetradecanoyloxy)propyl-1-O-(ω-methoxy(polyethoxy)ethyl)butanedioate (PEG-S-DMG), a PEGylated ceramide (PEG-cer), or a PEG dialkoxypropyl-carbamate such as ω-methoxy(polyethoxy)ethyl-N-(2,3di(tetradecanoxy)propyl)carbamate or 2,3-di(tetradecanoxy)propyl-N-(ω-methoxy(polyethoxy)ethyl)carbamate.

In preferred embodiments of the second aspect, the artificial RNA of the first aspect and, optionally, the further artificial RNA of the second aspect, is complexed with one or more lipids thereby forming lipid nanoparticles (LNP), wherein the LNP additionally comprises a PEGylated lipid with the formula (IV):

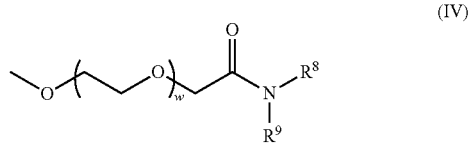
(IV)

or a pharmaceutically acceptable salt, tautomer or stereoisomer thereof, wherein $R^8$ and $R^9$ are each independently a straight or branched, saturated or unsaturated alkyl chain containing from 10 to 30 carbon atoms, wherein the alkyl chain is optionally interrupted by one or more ester bonds; and w has mean value ranging from 30 to 60.

In some of the foregoing embodiments of the PEGylated lipid according to formula (IV), $R^8$ and $R^9$ are not both n-octadecyl when w is 42. In some other embodiments, $R^8$ and $R^9$ are each independently a straight or branched, saturated or unsaturated alkyl chain containing from 10 to 18 carbon atoms. In some embodiments, $R^8$ and $R^9$ are each independently a straight or branched, saturated or unsaturated alkyl chain containing from 12 to 16 carbon atoms. In some embodiments, $R^8$ and $R^9$ are each independently a straight or branched, saturated or unsaturated alkyl chain containing 12 carbon atoms. In some embodiments, $R^8$ and $R^9$ are each independently a straight or branched, saturated or unsaturated alkyl chain containing 14 carbon atoms. In other embodiments, $R^8$ and $R^9$ are each independently a straight or branched, saturated or unsaturated alkyl chain containing 16 carbon atoms. In still more embodiments, $R^8$ and $R^9$ are each independently a straight or branched, saturated or unsaturated alkyl chain containing 18 carbon atoms. In still other embodiments, $R^8$ is a straight or branched, saturated or unsaturated alkyl chain containing 12 carbon atoms and $R^9$ is a straight or branched, saturated or unsaturated alkyl chain containing 14 carbon atoms.

In various embodiments, w spans a range that is selected such that the PEG portion of the PEGylated lipid according to formula (IV) has an average molecular weight of about 400 to about 6000 g/mol. In some embodiments, the average w is about 50.

In preferred embodiments of the second aspect, $R^8$ and $R^9$ of the PEGylated lipid according to formula (IV) are saturated alkyl chains.

In a particularly preferred embodiment of the second aspect, the artificial RNA of the first aspect and, optionally, the further artificial RNA of the second aspect, is complexed with one or more lipids thereby forming lipid nanoparticles (LNP), wherein the LNP additionally comprises a PEGylated lipid, wherein the PEG lipid is of formula (IVa)

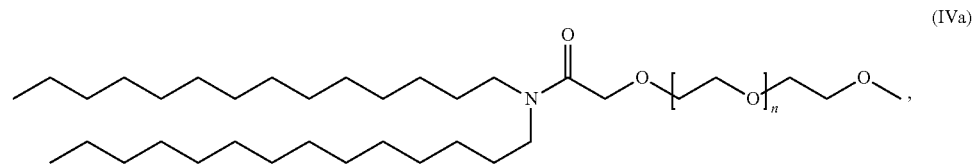
(IVa)

wherein n has a mean value ranging from 30 to 60, such as about 28 to about 32, about 30 to about 34, 32 to about 36, about 34 to about 38, 36 to about 40, about 38 to about 42, 40 to about 44, about 42 to about 46, 44 to about 48, about 46 to about 50, 48 to about 52, about 50 to about 54, 52 to about 56, about 54 to about 58, 56 to about 60, about 58 to about 62. In preferred embodiments, n is about 45, 46, 47, 48, 49, 50, 51, 52, 53, 54. In a most preferred embodiment n has a mean value of 49.

In other embodiments, the PEGylated lipid has one of the following structures:

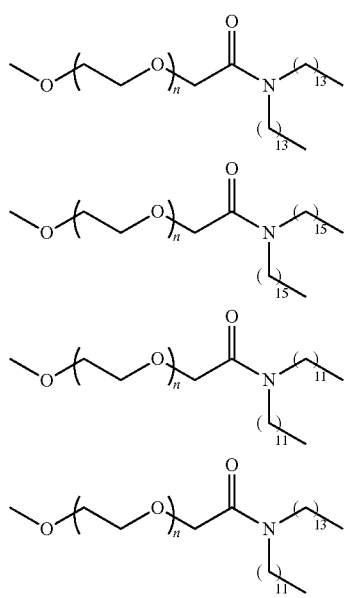

wherein n is an integer selected such that the average molecular weight of the PEGylated lipid is about 2500 g/mol, most preferably n is about 49.

Further examples of PEG-lipids suitable in that context are provided in US2015/0376115A1 and WO2015/199952, each of which is incorporated by reference in its entirety.

In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 3%, about 2.5%, about 2%, about 1.5%, about 1%, about 0.5%, or about 0.3% on a molar basis (based on 100% total moles of lipids in the LNP). In preferred embodiments, LNPs comprise from about 1.0% to about 2.0% of the PEG-modified lipid on a molar basis, e.g., about 1.2 to about 1.9%, about 1.2 to about 1.8%, about 1.3 to about 1.8%, about 1.4 to about 1.8%, about 1.5 to about 1.8%, about 1.6 to about 1.8%, in particular about 1.4%, about 1.5%, about 1.6%, about 1.7%, about 1.8%, about 1.9%, most preferably 1.7% (based on 100% total moles of lipids in the LNP). In various embodiments, the molar ratio of the cationic lipid to the PEGylated lipid ranges from about 100:1 to about 25:1.

In preferred embodiments, the LNP additionally comprises one or more additional lipids which stabilize the formation of particles during their formation (e.g. neutral lipid and/or one or more steroid or steroid analogue).

In preferred embodiments of the second aspect, the artificial RNA of the first aspect and, optionally, the further artificial RNA of the second aspect, is complexed with one or more lipids thereby forming lipid nanoparticles (LNP), wherein the LNP additionally comprises one or more neutral lipid and/or one or more steroid or steroid analogue.

Suitable stabilizing lipids include neutral lipids and anionic lipids. The term "neutral lipid" refers to any one of a number of lipid species that exist in either an uncharged or neutral zwitterionic form at physiological pH. Representative neutral lipids include diacylphosphatidylcholines, diacylphosphatidylethanolamines, ceramides, sphingomyelins, dihydro sphingomyelins, cephalins, and cerebrosides.

In embodiments of the second aspect, the LNP additionally comprises one or more neutral lipids, wherein the neutral lipid is selected from the group comprising distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1carboxylate (DOPE-mal), dipalmitoyl phosphatidyl ethanolamine (DPPE), dimyristoylphosphoethanolamine (DMPE), distearoyl-phosphatidylethanolamine (DSPE), 16-O-monomethyl PE, 16-O-dimethyl PE, 18-1-trans PE, 1-stearioyl-2-oleoylphosphatidyethanol amine (SOPE), and 1,2-dielaidoyl-sn-glycero-3-phophoethanolamine (transDOPE).

In some embodiments, the LNPs comprise a neutral lipid selected from DSPC, DPPC, DMPC, DOPC, POPC, DOPE and SM. In various embodiments, the molar ratio of the cationic lipid to the neutral lipid ranges from about 2:1 to about 8:1.

In preferred embodiments of the second aspect, the neutral lipid is 1,2-distearoyl-sn-glycero-3-phosphocholine (DSPC). The molar ratio of the cationic lipid to DSPC may be in the range from about 2:1 to 8:1.

In preferred embodiments of the second aspect, the steroid is cholesterol. The molar ratio of the cationic lipid to cholesterol may be in the range from about 2:1 to 1:1.

The sterol can be about 10 mol % to about 60 mol % or about 25 mol % to about 40 mol % of the lipid particle.

In one embodiment, the sterol is about 10, 15, 20, 25, 30, 35, 40, 45, 50, 55, or about 60 mol % of the total lipid present in the lipid particle. In another embodiment, the LNPs include from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the lipid nanoparticle).

Preferably, lipid nanoparticles (LNPs) comprise: (a) at least one artificial RNA of the first aspect, and, optionally, the further artificial RNA of the second aspect, (b) a cationic lipid, (c) an aggregation reducing agent (such as polyethylene glycol (PEG) lipid or PEG-modified lipid), (d) optionally a non-cationic lipid (such as a neutral lipid), and (e) optionally, a sterol.

In other preferred embodiments, lipid nanoparticles (LNPs) comprise: (a) at least one artificial RNA encoding F of the first aspect or a derivative or fragment thereof and at least one artificial RNA encoding N, M, P, or M2-1 of the second aspect or a derivative or fragment thereof, (b) a cationic lipid, (c) an aggregation reducing agent (such as polyethylene glycol (PEG) lipid or PEG-modified lipid), (d) optionally a non-cationic lipid (such as a neutral lipid), and (e) optionally, a sterol.

In some embodiments, the LNPs comprise a lipid of formula (III), an artificial RNA as defined herein, a neutral lipid, a steroid and a PEGylated lipid. In preferred embodiments, the lipid of formula (III) is lipid compound III-3, the neutral lipid is DSPC, the steroid is cholesterol, and the PEGylated lipid is the compound of formula (IVa).

In a preferred embodiment of the second aspect, the LNP consists essentially of (i) at least one cationic lipid; (ii) a neutral lipid; (iii) a sterol, e.g., cholesterol; and (iv) a PEG-lipid, e.g. PEG-DMG or PEG-cDMA, in a molar ratio of about 20-60% cationic lipid: 5-25% neutral lipid: 25-55% sterol; 0.5-15% PEG-lipid.

In particularly preferred embodiments of the second aspect, the artificial RNA of the first aspect and, optionally, the further artificial RNA of the second aspect, is complexed with one or more lipids thereby forming lipid nanoparticles (LNP), wherein the LNP essentially consists of
(i) at least one cationic lipid as defined herein, preferably a lipid of formula (III), more preferably lipid III-3;
(ii) a neutral lipid as defined herein, preferably 1,2-distearoyl-sn-glycero-3-phosphocholine (DSPC);
(iii) a steroid or steroid analogue as defined herein, preferably cholesterol; and
(iv) a PEG-lipid as defined herein, e.g. PEG-DMG or PEG-cDMA, preferably a PEGylated lipid of formula (IVa),
wherein (i) to (iv) are in a molar ratio of about 20-60% cationic lipid: 5-25% neutral lipid: 25-55% sterol; 0.5-15% PEG-lipid.

In one preferred embodiment, the lipid nanoparticle comprises: a cationic lipid with formula (III) and/or PEG lipid with formula (IV), optionally a neutral lipid, preferably 1,2-distearoyl-sn-glycero-3-phosphocholine (DSPC) and optionally a steroid, preferably cholesterol, wherein the molar ratio of the cationic lipid to DSPC is optionally in the range from about 2:1 to 8:1, wherein the molar ratio of the cationic lipid to cholesterol is optionally in the range from about 2:1 to 1:1.

In a particular preferred embodiment, the composition of the second aspect comprising the artificial RNA of the first aspect and, optionally, the further artificial RNA of the second aspect, comprises lipid nanoparticles (LNPs), which have a molar ratio of approximately 50:10:38.5:1.5, preferably 47.5:10:40.8:1.7 or more preferably 47.4:10:40.9:1.7 (i.e. proportion (mol %) of cationic lipid (preferably lipid III-3), DSPC, cholesterol and PEG-lipid ((preferably PEG-lipid of formula (IVa) with n=49); solubilized in ethanol).

In a particular preferred embodiment, the composition of the second aspect comprises lipid nanoparticles (LNPs), which have a molar ratio of approximately 50:10:38.5:1.5, preferably 47.5:10:40.8:1.7 or more preferably 47.4:10:40.9:1.7 (i.e. proportion (mol %) of cationic lipid (preferably lipid III-3), DSPC, cholesterol and PEG-lipid ((preferably PEG-lipid of Formula (IVa) with n=49); solubilized in ethanol), wherein the lipid nanoparticles comprise at least one RNA encoding F (F0, F-del, F0_DSCav1, F-del_DSCav1, F_DSCav1_mut0, F-del_DSCav1_mut0, F_DSCav1_mut1, F-del_DSCav1_mut1, F_DSCav1_mut2, F-del_DSCav1_mut2, F_DSCav1_mut3, F-del_DSCav1_mut3, F_DSCav1_mut4, F-del_DSCav1_mut4, F_DSCav1_mut5, F-del_DSCav1_mut5, F_DSCav1_mut6, F-del_DSCav1_mut6, F_DSCav1_mut7, F-del_DSCav1_mut7, F_DSCav1_mut8, or F-del_DSCav1_mut8), and, additionally lipid nanoparticles (LNPs), which have a molar ratio of approximately 50:10:38.5:1.5, preferably 47.5:10:40.8:1.7 or more preferably 47.4:10:40.9:1.7 (i.e. proportion (mol %) of cationic lipid (preferably lipid III-3), DSPC, cholesterol and PEG-lipid ((preferably PEG-lipid of Formula (IVa) with n=49); solubilized in ethanol), wherein the lipid nanoparticles comprise at least one RNA encoding M, N, M2-1, or P.

In a particular preferred embodiment, the composition of the second aspect comprises lipid nanoparticles (LNPs), which have a molar ratio of approximately 50:10:38.5:1.5, preferably 47.5:10:40.8:1.7 or more preferably 47.4:10:40.9:1.7 (i.e. proportion (mol %) of cationic lipid (preferably lipid III-3), DSPC, cholesterol and PEG-lipid ((preferably PEG-lipid of Formula (IVa) with n=49); solubilized in ethanol), wherein the lipid nanoparticles comprise at least one RNA encoding F (F0, F-del, F0_DSCav1, F-del_DSCav1, F_DSCav1_mut0, F-del_DSCav1_mut0, F_DSCav1_mut1, F-del_DSCav1_mut1, F_DSCav1_mut2, F-del_DSCav1_mut2, F_DSCav1_mut3, F-del_DSCav1_mut3, F_DSCav1_mut4, F-del_DSCav1_mut4, F_DSCav1_mut5, F-del_DSCav1_mut5, F_DSCav1_mut6, F-del_DSCav1_mut6, F_DSCav1_mut7, F-del_DSCav1_mut7, F_DSCav1_mut8, or F-del_DSCav1_mut8), and at least one RNA encoding M, N, M2-1, or P.

The total amount of RNA in the lipid nanoparticles may vary and is defined depending on the e.g. RNA to total lipid w/w ratio. In one embodiment of the invention the artificial RNA to total lipid ratio is less than 0.06 w/w, preferably between 0.03 w/w and 0.04 w/w.

In various embodiments, the LNP as defined herein have a mean diameter of from about 50 nm to about 200 nm, from about 60 nm to about 200 nm, from about 70 nm to about 200 nm, from about 80 nm to about 200 nm, from about 90 nm to about 200 nm, from about 90 nm to about 190 nm, from about 90 nm to about 180 nm, from about 90 nm to about 170 nm, from about 90 nm to about 160 nm, from about 90 nm to about 150 nm, from about 90 nm to about 140 nm, from about 90 nm to about 130 nm, from about 90 nm to about 120 nm, from about 90 nm to about 100 nm, from about 70 nm to about 90 nm, from about 80 nm to about 90 nm, from about 70 nm to about 80 nm, or about 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, 150 nm, 160 nm, 170 nm, 180 nm, 190 nm, or 200 nm and are substantially non-toxic. As used herein, the mean diameter may be represented by the z-average as determined by dynamic light scattering as commonly known in the art.

In another preferred embodiment of the invention the lipid nanoparticles have a hydrodynamic diameter in the range from about 50 nm to about 300 nm, or from about 60 nm to about 250 nm, from about 60 nm to about 150 nm, or from about 60 nm to about 120 nm, respectively.

According to further embodiments, the composition of the second aspect may comprise at least one adjuvant. Suitably, the adjuvant is preferably added to enhance the immunostimulatory properties of the composition.

The term "adjuvant" as used herein will be recognized and understood by the person of ordinary skill in the art, and is for example intended to refer to a pharmacological and/or immunological agent that may modify, e.g. enhance, the effect of other agents (herein: the effect of the artificial nucleic acid of the invention) or that may be suitable to support administration and delivery of the composition. The term "adjuvant" refers to a broad spectrum of substances. Typically, these substances are able to increase the immunogenicity of antigens. For example, adjuvants may be recognized by the innate immune systems and, e.g., may elicit an innate immune response (that is, a non-specific immune response). "Adjuvants" typically do not elicit an adaptive immune response. In the context of the invention, adjuvants may enhance the effect of the antigenic peptide or protein provided by the artificial nucleic acid as defined herein or the polyprotein as defined herein.

In that context, the at least one adjuvant may be selected from any adjuvant known to a skilled person and suitable for the present case, i.e. supporting the induction of an immune response in a subject, e.g. in a human subject.

Accordingly, the composition of the second aspect may comprise at least one adjuvant, wherein the at least one adjuvant may be suitably selected from any adjuvant provided in of published PCT application WO2016/203025. Adjuvants disclosed in any of the claims 2 to 17 of WO2016/203025, preferably adjuvants disclosed in claim 17 of WO2016/203025 are particularly suitable, the specific content relating thereto herewith incorporated by reference.

The composition of the second aspect may comprise, besides the components specified herein, at least one further component which may be selected from the group consisting of further antigens (e.g. in the form of a peptide or protein) or further antigen-encoding nucleic acids; a further immunotherapeutic agent; one or more auxiliary substances (cytokines, such as monokines, lymphokines, interleukins or chemokines); or any further compound, which is known to be immune stimulating due to its binding affinity (as ligands) to human Toll-like receptors; and/or an adjuvant nucleic acid, preferably an immunostimulatory RNA (isRNA), e.g. CpG-RNA etc.

Polypeptide and Composition Comprising the Polypeptide

In a third aspect, the present invention provides a polypeptide, preferably an antigenic polypeptide, wherein the polypeptide comprises an amino acid sequence or a fragment thereof encoded by the artificial RNA of the first aspect.

In embodiments, the polypeptide has an amino acid sequence which is identical or at least 70%, 80%, 85%, 86%, 87%, 88%, 89%, 90%, 91%, 92%, 93%, 94%, 95%, 96%, 97%, 98%, or 99% identical to SEQ ID NO: 68, 483, 898, 1267, 1636, 2005, 2374, 2743, 3112, 3481, 3850, 4219, 4588, 4957, 5326, 5695, 6064, 6433, 6802, 7171, 7540, 7909, 11726, 12095, 12464, 12833, 13940, 14309, 14678, 15047, 15416, 15785, 13202, 13571, 16154, 16523, 16892, 17261, 17630, 17999, 18368, 18737, 19106, 19475 or a variant of any of these polypeptides.

In preferred embodiments, the polypeptide has an amino acid sequence which is identical or at least 70%, 80%, 85%, 86%, 87%, 88%, 89%, 90%, 91%, 92%, 93%, 94%, 95%, 96%, 97%, 98%, or 99% identical to SEQ ID NOs: 1267, 2005, 2743, 3481, 4219, 4957, 5695, 6433, 7171, 7909, 12833, 14309, 15047, 15785, 13571, 16523, 17261, 17999, 18737, 19475 or a variant of any of these polypeptides.

In a fourth aspect, the invention relates to an immunogenic composition, comprising the polypeptide of the third aspect. In preferred embodiments, the composition of the fourth aspect may additionally comprise at least one pharmaceutically acceptable carrier as defined herein. In preferred embodiments, the composition of the fourth aspect may additionally comprise at least one artificial RNA of the first aspect and, optionally, at least one further artificial RNA of the second aspect, or an RNA composition of the second aspect.

Notably, embodiments relating to the composition of the second aspect or the vaccine of the fifth aspect may likewise be read on and be understood as suitable embodiments of the composition of the fourth aspect.

Vaccine:

In a fifth aspect, the present invention provides a vaccine wherein the vaccine comprises the RNA of the first aspect, and, optionally, the composition of the second aspect, the polypeptide of the third aspect, or the composition of the fourth aspect.

Notably, embodiments relating to the composition of the second aspect or the composition of the fourth aspect may likewise be read on and be understood as suitable embodiments of the vaccine of the fifth aspect. Also, embodiments relating to the vaccine of the fifth aspect may likewise be read on and be understood as suitable embodiments of the composition of the second aspect (comprising the RNA of the first aspect and, optionally, the further artificial RNA of the second aspect) or the composition of the fourth aspect (comprising the polypeptide of the third aspect).

The term "vaccine" will be recognized and understood by the person of ordinary skill in the art, and is for example intended to be a prophylactic or therapeutic material providing at least one epitope or antigen, preferably an immunogen. In the context of the invention the antigen or antigenic function is provided by the inventive RNA of the first aspect (said RNA comprising a coding sequence encoding a antigenic peptide or protein derived from RSV F protein), the composition of the second aspect (comprising the RNA of the first aspect and, optionally, the further artificial RNA of the second aspect), the polypeptide of the third aspect, or the composition of the fourth aspect (comprising said polypeptide).

In preferred embodiments of the fifth aspect, the vaccine comprises the RNA of the first aspect, the composition of the second aspect (comprising the RNA of the first aspect and, optionally, the further artificial RNA of the second aspect), the polypeptide of the third aspect, or the composition of the fourth aspect wherein said RNA, said composition of the second aspect, said polypeptide, or said composition of the fourth aspect (comprising said polypeptide) elicits an adaptive immune response.

In particularly preferred embodiments, the vaccine comprises the RNA of the first aspect or the composition of the second aspect wherein said RNA or said composition elicits an adaptive immune response, preferably an adaptive immune response against RSV.

In particularly preferred embodiments, the vaccine comprises the RNA of the first aspect or the composition of the second aspect wherein said RNA or said composition induces a T cell immune response, According to a preferred embodiment of the fifth aspect, the vaccine as defined herein may further comprise a pharmaceutically acceptable carrier and optionally at least one adjuvant as specified in the context of the second aspect.

Suitable adjuvants in that context may be selected from adjuvants disclosed in claim 17 of WO2016/203025.

In a preferred embodiment, the vaccine is a monovalent vaccine.

In embodiments the vaccine is a polyvalent vaccine comprising a plurality or at least more than one of the artificial RNAs as defined in the context of the first aspect, and, optionally, at least more than one of the further artificial RNAs as defined in the context of the second aspect. Embodiments relating to a polyvalent composition as disclosed in the context of the second aspect may likewise be read on and be understood as suitable embodiments of the polyvalent vaccine of the fifth aspect.

The vaccine of the fifth aspect typically comprises a safe and effective amount of the RNA of the first aspect and, optionally, the further RNA of the second aspect. As used herein, "safe and effective amount" means an amount of the RNA that is sufficient to significantly induce a positive modification of a disease or disorder related to an infection with a RSV. At the same time, a "safe and effective amount" is small enough to avoid serious side-effects. In relation to the vaccine or composition of the present invention, the expression "safe and effective amount" preferably means an amount of the RNA that is suitable for stimulating the adaptive immune system in such a manner that no excessive or damaging immune reactions are achieved but, preferably, also no such immune reactions below a measurable level.

A "safe and effective amount" of the RNA of the composition or vaccine as defined above will furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying medical doctor. Moreover, the "safe and effective amount" of the RNA, the composition, the vaccine may depend from application route (intradermal, intramuscular), application device (jet injection, needle injection, microneedle patch) and/or complexation (protamine complexation or LNP encapsulation). Moreover, the "safe and effective amount" of the artificial RNA, the composition, the vaccine may depend from the condition of the treated subject (infant, pregnant women, immunocompromised human subject etc.). Accordingly, the suitable "safe and effective amount" has to be adapted accordingly and will be chosen and defined by the skilled person.

The vaccine can be used according to the invention for human medical purposes and also for veterinary medical purposes (mammals, vertebrates, avian species), as a pharmaceutical composition, or as a vaccine.

In a preferred embodiment, the RNA, the composition (comprising said RNA and, optionally, a further RNA), the polypeptide, the composition (comprising said polypeptide), or the vaccine is provided in lyophilized form (using e.g. lyophilisation methods as described in WO2016/165831, WO2011/069586, WO2016/184575 or WO2016/184576). Preferably, the lyophilized RNA, the lyophilized composition, the lyophilized polypeptide, the lyophilized composition comprising the polypeptide, or the lyophilized vaccine is reconstituted in a suitable buffer, advantageously based on an aqueous carrier, prior to administration, e.g. Ringer-Lactate solution or a phosphate buffer solution.

Accordingly, the pharmaceutically acceptable carrier as used herein preferably includes the liquid or non-liquid basis of the inventive vaccine. If the inventive vaccine is provided in liquid form, the carrier will be water, typically pyrogen-free water; isotonic saline or buffered (aqueous) solutions, e.g. phosphate, citrate etc. buffered solutions. Preferably, Ringer-Lactate solution is used as a liquid basis for the vaccine or the composition according to the invention as described in WO2006/122828, the disclosure relating to suitable buffered solutions incorporated herewith by reference.

The choice of a pharmaceutically acceptable carrier as defined herein is determined, in principle, by the manner, in which the pharmaceutical composition(s) or vaccine according to the invention is administered. The vaccine can be administered, for example, systemically or locally. Routes for systemic administration in general include, for example, transdermal, oral, parenteral routes, including subcutaneous, intravenous, intramuscular, intra-arterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, intraarticular and sublingual injections. More preferably, composition or vaccines according to the present invention may be administered by an intradermal, subcutaneous, or intramuscular route, preferably by injection, which may be needle-free and/or needle injection. Compositions/vaccines are therefore preferably formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the inventive composition or vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

The inventive vaccine or composition as defined herein can additionally contain one or more auxiliary substances as defined above in order to further increase the immunogenicity. A synergistic action of the nucleic acid contained in the inventive composition and of an auxiliary substance, which may be optionally be co-formulated (or separately formulated) with the inventive vaccine or composition as described above, is preferably achieved thereby. Such immunogenicity increasing agents or compounds may be provided separately (not co-formulated with the inventive vaccine or composition) and administered individually.

Further additives which may be included in the inventive vaccine or composition are emulsifiers, such as for example, Tween; wetting agents, such as, for example, sodium lauryl sulfate; colouring agents; taste-imparting agents, pharmaceutical carriers; tablet-forming agents; stabilizers; antioxidants; preservatives.

Kit or Kit of Parts, Application, Medical Uses, Method of Treatment:

In a sixth aspect, the present invention provides a kit or kit of parts, wherein the kit or kit of parts comprises the RNA of the first aspect, the composition of the second aspect (comprising said RNA), the polypeptide of the third aspect, the composition of the fourth aspect (comprising said polypeptide), and/or the vaccine of the fifth aspect, optionally comprising a liquid vehicle for solubilising, and optionally technical instructions providing information on administration and dosage of the components.

In a preferred embodiment, the kit of the sixth aspect comprises at least the following components
  a) at least one RNA of the first aspect, preferably encoding at least one antigenic peptide or protein derived from a RSV fusion (F) protein (RNA sequences preferably selected from Table 5 or 6), wherein said artificial RNA is preferably complexed with one or more lipids thereby forming lipid nanoparticles (LNP); and
  b) at least one, two, or three further artificial RNA encoding an antigenic peptide or protein derived from RSV selected from M, N, M2-1, or P (RNA sequences preferably selected from Table 7A), wherein said further RNA is preferably complexed with one or more lipids thereby forming lipid nanoparticles (LNP),
  wherein components a) and b) are provided as separate entities or as a single entity.

In a preferred embodiment, the kit of the sixth aspect comprises at least the following components
  a) at least one RNA of the first aspect, preferably encoding at least one antigenic peptide or protein derived from a RSV fusion (F) protein (RNA sequences preferably selected from Table 5 or 6), wherein said artificial RNA is preferably complexed with one or more lipids thereby forming lipid nanoparticles (LNP); and
  b) at least one further artificial RNA encoding an antigenic peptide or protein derived from RSV selected from M (RNA sequences preferably selected from Table 7A, Column A), wherein said further RNA is preferably complexed with one or more lipids thereby forming lipid nanoparticles (LNP); and
  c) at least one further artificial RNA encoding an antigenic peptide or protein derived from RSV selected from P (RNA sequences preferably selected from Table 7A, Column C), wherein said further RNA is preferably complexed with one or more lipids thereby forming lipid nanoparticles (LNP),
  wherein components a), b) and c) are provided as separate entities or as a single entity.

In a preferred embodiment, the kit of the sixth aspect comprises at least the following components
  a) at least one RNA of the first aspect, preferably encoding at least one antigenic peptide or protein derived from a RSV fusion (F) protein (RNA sequences preferably selected from Table 5 or 6), wherein said artificial RNA is preferably complexed with one or more lipids thereby forming lipid nanoparticles (LNP); and
  b) at least one further artificial RNA encoding an antigenic peptide or protein derived from RSV selected from M (RNA sequences preferably selected from Table 7A, Column A), wherein said further RNA is preferably complexed with one or more lipids thereby forming lipid nanoparticles (LNP); and
  c) at least one further artificial RNA encoding an antigenic peptide or protein derived from RSV selected from P (RNA sequences preferably selected from Table 7A, Column C), wherein said further RNA is preferably complexed with one or more lipids thereby forming lipid nanoparticles (LNP); and
  d) at least one further artificial RNA encoding an antigenic peptide or protein derived from RSV selected from P (RNA sequences preferably selected from Table 7A, Column B), wherein said further RNA is preferably complexed with one or more lipids thereby forming lipid nanoparticles (LNP),
  wherein components a), b), c) and d) are provided as separate entities or as a single entity.

The kit may further comprise additional components as described in the context of the composition of the second aspect, the polypeptide of the third aspect, the composition of the fourth aspect, and/or the vaccine of the fifth aspect.

The technical instructions of said kit may contain information about administration and dosage and patient groups. Such kits, preferably kits of parts, may be applied e.g. for any of the applications or uses mentioned herein, preferably for the use of the RNA of the first aspect, the composition of the second aspect, the polypeptide of the third aspect, the composition of the fourth aspect, or the vaccine of the fifth aspect, for the treatment or prophylaxis of an infection or diseases caused by RSV or disorders related thereto. Preferably, the RNA of the first aspect, the composition of the second aspect, the polypeptide of the third aspect, the composition of the fourth aspect, or the vaccine of the fifth aspect is provided in a separate part of the kit, wherein the RNA of the first aspect, the composition of the second aspect, the polypeptide of the third aspect, the composition of the fourth aspect, or the vaccine of the fifth aspect is preferably lyophilised. The kit may further contain as a part a vehicle (e.g. buffer solution) for solubilising the RNA of the first aspect, the composition of the second aspect, the polypeptide of the third aspect, the composition fourth aspect, or the vaccine of the fifth aspect.

In preferred embodiments, the kit or kit of parts as defined herein comprises Ringer lactate solution.

Any of the above kits may be used in a treatment or prophylaxis as defined herein. More preferably, any of the above kits may be used as a vaccine, preferably a vaccine against infections caused by RSV as defined herein.

Medical Use:

In a further aspect, the present invention relates to the first medical use of the RNA of the first aspect, the composition of the second aspect, the polypeptide of the third aspect, the composition of the fourth aspect, the vaccine of the fifth aspect, or the kit or kit of parts of the sixth aspect.

Accordingly, the RNA of the first aspect, the composition of the second aspect, the polypeptide of the third aspect, the composition of the fourth aspect, the vaccine of the fifth aspect, or the kit or kit of parts of the sixth aspect is for use as a medicament.

The present invention furthermore provides several applications and uses of the RNA of the first aspect, the composition of the second aspect, the polypeptide of the third aspect, the composition of the fourth aspect, the vaccine of the fifth aspect, or the kit or kit of parts of the sixth aspect.

In particular, said RNA, composition (comprising said RNA), polypeptide, composition (comprising said polypeptide), vaccine, or the kit or kit of parts may be used for human medical purposes and also for veterinary medical purposes, preferably for human medical purposes.

In particular, said RNA, composition (comprising said RNA), polypeptide, composition (comprising said polypeptide), vaccine, or the kit or kit of parts may is for use as a medicament for human medical purposes, wherein said RNA, composition (comprising said RNA), polypeptide, composition (comprising said polypeptide), vaccine, or the kit or kit of parts may be particularly suitable for young infants, newborns, immunocompromised recipients, as well as pregnant and breast-feeding women and elderly people.

In yet another aspect, the present invention relates to the second medical use of the RNA of the first aspect, the composition of the second aspect, the polypeptide of the third aspect, the composition of the fourth aspect, the vaccine of the fifth aspect, or the kit or kit of parts of the sixth aspect.

Accordingly, the RNA of the first aspect, the composition of the second aspect, the polypeptide of the third aspect, the composition of the fourth aspect, the vaccine of the fifth aspect, or the kit or kit of parts of the sixth aspect is for use in the treatment or prophylaxis of an infection with a pathogen (e.g. a virus), in particular with Respiratory syncytial virus (RSV), or a disorder related to such an infection.

In particular, the RNA of the first aspect, the composition of the second aspect, the polypeptide of the third aspect, the composition of the fourth aspect, the vaccine of the fifth aspect, or the kit or kit of parts of the sixth aspect may be used in the treatment or prophylaxis of an infection with a virus, in particular with RSV, or a disorder related to such an infection for human and also for veterinary medical purposes, preferably for human medical purposes.

In particular, said RNA, composition (comprising said RNA), polypeptide, composition (comprising said polypeptide), vaccine, or the kit or kit of parts may be particularly suitable for young infants, newborns, immunocompromised recipients, as well as pregnant and breast-feeding women and elderly people for use in the treatment or prophylaxis of an infection with RSV.

As used herein, "a disorder related to a RSV infection" may preferably comprise a typical symptom or a complication of an RSV infection.

Particularly, the artificial RNA of the first aspect, the composition of the second aspect, the polypeptide of the third aspect, the composition of the fourth aspect, the vaccine of the fifth aspect, or the kit or kit of parts of the sixth aspect may be used in a method of prophylactic (pre-exposure prophylaxis or post-exposure prophylaxis) and/or therapeutic treatment of infections caused by RSV.

The composition or the vaccine as defined herein may preferably be administered locally. In particular, composition or vaccines may be administered by an intradermal, subcutaneous, intranasal, or intramuscular route. Inventive compositions or vaccines of the invention are therefore preferably formulated in liquid (or sometimes in solid) form. In embodiments, the inventive vaccine may be administered by conventional needle injection or needle-free jet injection. Preferred in that context is the RNA, the composition, the vaccine is administered by intramuscular needle injection.

The term "jet injection", as used herein, refers to a needle-free injection method, wherein a fluid (vaccine, composition of the invention) containing e.g. at least one RNA of the first aspect is forced through an orifice, thus generating an ultra-fine liquid stream of high pressure that is capable of penetrating mammalian skin and, depending on the injection settings, subcutaneous tissue or muscle tissue. In principle, the liquid stream perforates the skin, through which the liquid stream is pushed into the target tissue. Preferably, jet injection is used for intradermal, subcutaneous or intramuscular injection of the RNA, the compositions, the vaccines disclosed herein.

In embodiments, the RNA as comprised in a composition or vaccine as defined herein is provided in an amount of about 100 ng to about 500 µg, in an amount of about 1 µg to about 200 µg, in an amount of about 1 µg to about 100 µg, in an amount of about 5 µg to about 100 µg, preferably in an amount of about 10 µg to about 50 µg, specifically, in an amount of about 5 µg, 10 µg, 15 µg, 20 µg, 25 µg, 30 µg, 35 µg, 40 µg, 45 µg, 50 µg, 55 µg, 60 µg, 65 µg, 70 µg, 75 µg, 80 µg, 85 µg, 90 µg, 95 µg or 100 µg.

Depending from application route (intradermal, intramuscular, intranasal), application device (jet injection, needle injection, microneedle patch) and/or complexation (preferably LNP encapsulation) the suitable amount has to be adapted accordingly and will be chosen and defined by the skilled person.

The immunization protocol for the treatment or prophylaxis of an infection as defined herein, i.e. the immunization of a subject against a RSV, typically comprises a series of single doses or dosages of the composition or the vaccine. A single dosage, as used herein, refers to the initial/first dose, a second dose or any further doses, respectively, which are preferably administered in order to "boost" the immune reaction.

In one embodiment, the immunization protocol for the treatment or prophylaxis of an infection as defined herein, i.e. the immunization of a subject against a RSV, comprises one single doses of the composition or the vaccine.

In preferred embodiments, the immunization protocol for the prophylaxis of an infection with RSV comprises at least one single dose of the composition or the vaccine as defined herein, wherein said at least one single dose is administered to a pregnant women for maternal immunization, thereby achieving immunization of the unborn child and/or wherein said at least one single dose is administered to a breast-feeding women for thereby achieving passive immunization of the breast-fed child.

The treatment or prophylaxis as defined above may comprise the administration of a further active pharmaceutical ingredient. In the case of the inventive vaccine or composition, which is based on the artificial RNA of the first aspect, a polypeptide, preferably of the third aspect may be co-administered as a further active pharmaceutical ingredient.

For example, at least one RSV protein or peptide as described herein, or a fragment or variant thereof, may be co-administered in order to induce or enhance an immune response. Further, two distinct artificial RNAs of the first aspect and, optionally further RNAs of the second aspect may be administered at different time points, preferably in a prime-boost scenario, e.g. using a composition comprising at least one RSV polypeptide as prime vaccination and a composition/vaccine comprising at least one artificial RNA of the first aspect as boost vaccination.

Suitably, the treatment or prophylaxis as defined above comprises the administration of a further active pharmaceutical ingredient, wherein the further active pharmaceutical ingredient may be an immunotherapeutic agent that can be selected from immunoglobulins, preferably IgGs, monoclonal or polyclonal antibodies, polyclonal serum or sera, etc., most preferably immunoglobulins directed against a RSV protein or peptide as defined herein. Preferably, such a further immunotherapeutic agent may be provided as a peptide/protein or may be encoded by a nucleic acid, preferably by a DNA or an RNA, more preferably an mRNA. Such an immunotherapeutic agent allows providing passive vaccination additional to active vaccination triggered by the inventive artificial RNA or by the inventive polypeptide.

Method of Treatment and Use, Diagnostic Method and Use:

In another aspect, the present invention relates to a method of treating or preventing a disorder.

In preferred embodiments, the present invention relates to a method of treating or preventing a disorder, wherein the method comprises applying or administering to a subject in need thereof the RNA of the first aspect, the composition of the second aspect, the polypeptide of the third aspect, the composition of the fourth aspect, the vaccine of the fifth aspect, or the kit or kit of parts of the sixth aspect.

In preferred embodiments, the disorder is an infection with Respiratory syncytial virus (RSV), or a disorder related to such an infection.

In preferred embodiments, the present invention relates to a method of treating or preventing a disorder, wherein the method comprises applying or administering to a subject in need thereof the RNA of the first aspect, the composition of the second aspect, the polypeptide of the third aspect, the composition of the fourth aspect, the vaccine of the fifth aspect, or the kit or kit of parts of the sixth aspect, wherein the subject in need is preferably a mammalian subject. In particularly preferred embodiments, the mammalian subject is a human subject, particularly an infant, a newborn, a pregnant women, a breast-feeding woman, an elderly, or an immunocompromised human subject.

In particular, such a method may preferably comprise the steps of:
- a) providing the RNA of the first aspect, the composition of the second aspect, the polypeptide of the third aspect, the composition of the fourth aspect, the vaccine of the fifth aspect, or the kit or kit of parts of the sixth aspect;
- b) applying or administering said RNA of the first aspect, composition of the second aspect, polypeptide of the third aspect, composition of the fourth aspect, vaccine of the fifth aspect, or kit or kit of parts of the sixth aspect to a tissue or an organism;
- c) optionally, administering immunoglobulin (IgGs) against a RSV;
- d) optionally, administering a further substance (adjuvant, auxiliary substance, further antigen).

According to a further aspect, the present invention also provides a method for expression of at least one polypeptide comprising at least one peptide or protein derived from a RSV, or a fragment or variant thereof, wherein the method preferably comprises the following steps:
- a) providing the RNA of the first aspect or the composition of the second aspect; and
- b) applying or administering said RNA or composition to an expression system (cells), a tissue, an organism.

The method may be applied for laboratory, for research, for diagnostic, for commercial production of peptides or proteins and/or for therapeutic purposes. The method may furthermore be carried out in the context of the treatment of a specific disease, particularly in the treatment of infectious diseases, particularly RSV infections.

Likewise, according to another aspect, the present invention also provides the use of the artificial RNA of the first aspect, the composition of the second aspect, the polypeptide of the third aspect, the composition of the fourth aspect, the vaccine of the fifth aspect, or the kit or kit of parts of the sixth aspect preferably for diagnostic or therapeutic purposes, e.g. for expression of an encoded RSV antigenic peptide or protein, e.g. by applying or administering said RNA, composition comprising said RNA, vaccine comprising said RNA, e.g. to a cell-free expression system, a cell (e.g. an expression host cell or a somatic cell), a tissue or an organism. In specific embodiments, applying or administering said RNA, composition comprising said RNA, vaccine comprising said RNA to a tissue or an organism is followed by e.g. a step of obtaining induced RSV F antibodies e.g. RSV F specific (monoclonal) antibodies.

The use may be applied for a (diagnostic) laboratory, for research, for diagnostics, for commercial production of peptides, proteins, or RSV antibodies and/or for therapeutic purposes. The use may be carried out in vitro, in vivo or ex vivo. The use may furthermore be carried out in the context of the treatment of a specific disease, particularly in the treatment of an RSV infection or a related disorder.

In a particularly preferred embodiment, the invention provides the RNA of the first aspect, the composition of the second aspect, the polypeptide of the third aspect, the composition of the fourth aspect, the vaccine of the fifth aspect, or the kit or kit of parts of the sixth aspect for use as a medicament, for use in treatment or prophylaxis, preferably treatment or prophylaxis of an RSV infection or a related disorder, or for use as a vaccine.

BRIEF DESCRIPTION OF LISTS AND TABLES

List 1: Suitable RSV virus strains
List 2: NCBI Protein Accession numbers of suitable RSV fusion (F) proteins
Table 1: Preferred RSV F protein antigen designs
Table 2: Human codon usage table with frequencies indicated for each amino acid
Table 3A: Preferred coding sequences encoding RSV F (columns A-J), derived from HRSV(A2)
Table 3B: Preferred coding sequences encoding RSV F (columns A-J), derived from HRSV(Memphis-37)
Table 4A: Preferred coding sequences encoding RSV F (columns K-V), derived from HRSV(A2)
Table 4B: Preferred coding sequences encoding RSV F (columns K-V), derived from HRSV(Memphis-37)
Table 5A: Preferred mRNA constructs encoding RSV F (columns A-J), derived from HRSV(A2)
Table 5B: Preferred mRNA constructs encoding RSV F (columns A-J), derived from HRSV(Memphis-37)
Table 6A: Preferred mRNA constructs encoding RSV F (column K-V), derived from HRSV(A2)
Table 6B: Preferred mRNA constructs encoding RSV F (column K-V), derived from HRSV(Memphis-37)
Table 7A: Preferred further coding sequences and mRNA constructs of the composition or vaccine
Table 7B: Suitable combinations of RNA constructs
Table 8: Representative lipid compounds derived from formula (III)
Table 9: mRNA constructs used in the present examples (see Examples section)
Table 10: Animal groups and vaccination schedule of Example 2 (see Examples section)
Table 11: Animal groups and vaccination schedule of Example 3 (see Examples section)
Table 12: mRNA constructs with different UTR combinations of Example 4 (see Examples section)
Table 13: Animal groups and vaccination schedule of Example 5 (see Examples section)
Table 14: Animal groups and vaccination schedule of Example 6 (see Examples section)
Table 15: Animal groups and vaccination schedule of Example 7 (see Examples section)
Table 15: Animal groups and vaccination schedule of Example 7 (see Examples section)
Table 16: Overview of mRNA constructs used in Example 8 (see Examples section)
Table 17: Animal groups and vaccination schedule of Example 9 (see Examples section)
Table 18: Animal groups and vaccination schedule of Example 10 (see Examples section)

Table 19: Overview of mRNA constructs used in Example 11 (see Examples section)

Table 20: Animal groups and vaccination schedule of Example 12 (see Examples section)

BRIEF DESCRIPTION OF THE DRAWINGS

FIG. 5A: Antibody titers determined on day 49; FIGS. 5B and 5C: time-dependent IgG titers in serum with 10 µg mRNA (FIG. 5B) or 100 µg mRNA (FIG. 5C) encoding RSV F-protein (F, F-del, and F-del_DSCav1). Vaccination schedule see Table 11. Further details are provided in Example 3.

FIG. 18 shows the results of the analysis of lung viral titers and of nose viral titers in cotton rats challenged with RSV virus. Vaccination schedule see Table 18. Further details are provided in Example 10.

EXAMPLES

Figure 1:
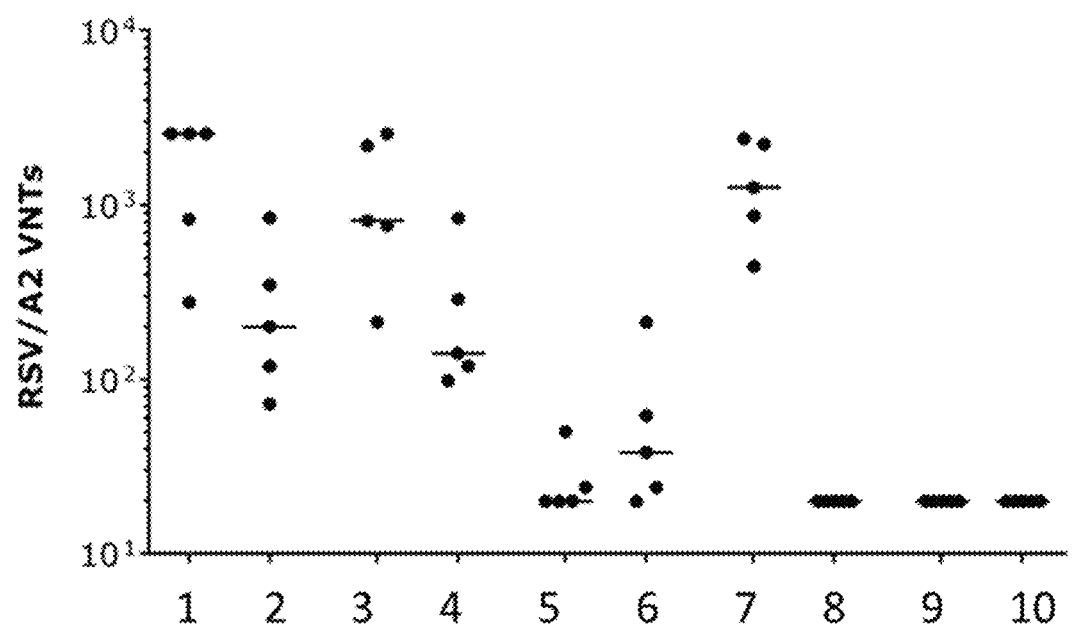
FIG. 1 shows that LNP-formulated mRNA encoding RSV F-protein (F-del_DSCav1) induces high virus neutralization titers (VNTs) in serum of cotton rats after i.m. and i.d. vaccinations. Vaccination with protamine-formulated mRNA induces only weak responses. Vaccination schedule see Table 10. Further details are provided in Example 2.

In the following, particular examples illustrating various embodiments and aspects of the invention are presented. However, the present invention shall not to be limited in scope by the specific embodiments described herein. The following preparations and examples are given to enable those skilled in the art to more clearly understand and to practice the present invention. The present invention, however, is not limited in scope by the exemplified embodiments, which are intended as illustrations of single aspects of the invention only, and methods which are functionally equivalent are within the scope of the invention. Indeed, various modifications of the invention in addition to those described herein will become readily apparent to those skilled in the art from the foregoing description, accompanying figures and the examples below. All such modifications fall within the scope of the appended claims.

Example 1: Preparation of DNA and mRNA Constructs and Compositions for In Vitro and In Vivo Experiments The present Example provides methods of obtaining the artificial RNA of the invention as well as methods of generating a composition or a vaccine of the invention.

1.1. Preparation of DNA and mRNA Constructs:

For the present examples, DNA sequences encoding different RSV F proteins (e.g. F0, F-del, F-del_DSCav1, F-del_DSCav1_mut5, etc.) were prepared and used for subsequent RNA in vitro transcription reactions. Said DNA sequences were prepared by modifying the wild type encoding DNA sequences by introducing a G/C optimized coding sequence (e.g., "cds opt1") for stabilization. Sequences were introduced into a pUC19 derived vector to comprise stabilizing 3'-UTR sequences derived from a 3'-UTR of a gene selected from PSMB3, ALB7, alpha-globin, CASP1, COX6B1, GNAS, NDUFA1 and RPS9 and 5'-UTR sequences derived from a 5'-UTR of a gene selected from HSD17B4, RPL32, ASAH1, ATP5A1, MP68, NDUFA4, NOSIP, RPL31, SLC7A3, TUBB4B and UBQLN2, additionally comprising, a stretch of adenosines (e.g. 64A or A100), and a histone-stem-loop (hSL) structure, and optionally a stretch of 30 cytosines (e.g. C30) as listed in Table 9.

The obtained plasmid DNA constructs were transformed and propagated in bacteria using common protocols known in the art. Eventually, the plasmid DNA constructs were extracted, purified, and used for subsequent RNA in vitro transcription (see section 1.2.).

Alternatively, DNA plasmids prepared according to paragraph 1 are used as DNA template for PCR-based amplification. Eventually, the generated PCR products are purified and used for subsequent RNA in vitro transcription (see section 1.3.).

1.2. RNA In Vitro Transcription from Plasmid DNA Templates:

DNA plasmids prepared according to paragraph 1.1 were enzymatically linearized using EcoRI or SapI and used for DNA dependent RNA in vitro transcription using T7 RNA polymerase in the presence of a nucleotide mixture (ATP/GTP/CTP/UTP) and cap analog (e.g., m7GpppG, m7G(5')ppp(5')(2'OMeA)pG, or m7G(5')ppp(5')(2'OMeG)pG)) under suitable buffer conditions. The obtained mRNA constructs were purified using RP-HPLC (PureMessenger®, CureVac AG, Tübingen, Germany; WO2008/077592) and used for in vitro and in vivo experiments. RNA for clinical development (see Example 6) is produced under current good manufacturing practice e.g. according to WO2016/180430, implementing various quality control steps on DNA and RNA level. The generated RNA sequences/constructs are provided in Table 9 with the encoded F protein and the respective UTR elements indicated therein. In addition to the information provided in Table 9, further information relating to specific mRNA construct SEQ-ID NOs may be derived from the information provided under <223> identifier provided in the ST.25 sequence listing.

Alternatively, EcoRI or SapI linearized DNA is used for DNA dependent RNA in vitro transcription using an RNA polymerase in the presence of a modified nucleotide mixture (ATP, GTP, CTP, N(1)-methylpseudouridine (m1ψ) or pseudouridine (ψ)) and cap analog (m7GpppG, m7G(5')ppp(5')(2'OMeA)pG, or m7G(5')ppp(5')(2'OMeG)pG) under suitable buffer conditions. The obtained m1ψ or ψ-modified mRNAs are purified using RP-HPLC (PureMessenger®, CureVac, Tübingen, Germany; WO2008/077592) and used for further experiments.

Some mRNA constructs are in vitro transcribed in the absence of a cap analog. The cap-structure (cap1) is added enzymatically using Capping enzymes as commonly known in the art. In short, in vitro transcribed mRNA is capped using an m7G capping kit with 2'-O-methyltransferase to obtain cap1-capped mRNA. Cap1-capped mRNA is purified using RP-HPLC (PureMessenger®, CureVac, Tübingen, Germany; WO2008/077592) and used for further experiments.

1.3. RNA In Vitro Transcription from PCR Amplified DNA Templates:

Purified PCR amplified DNA templates prepared according to paragraph 1.1 are transcribed in vitro using DNA dependent T7 RNA polymerase in the presence of a nucleotide mixture (ATP/GTP/CTP/UTP) and cap analog (m7GpppG) under suitable buffer conditions. Alternatively, PCR amplified DNA is transcribed in vitro using DNA dependent T7 RNA polymerase in the presence of a modified nucleotide mixture (ATP, GTP, CTP, N(1)-methylpseudouridine (m1ψ)) and cap analog (m7GpppG) under suitable buffer conditions. Some mRNA constructs are in vitro transcribed in the absence of a cap analog and the cap-structure (cap1) is added enzymatically using capping enzymes as commonly known in the art e.g. using an m7G capping kit with 2'-O-methyltransferase. The obtained mRNAs are purified e.g. using RP-HPLC (PureMessenger®, CureVac AG, Tübingen, Germany; WO2008/077592) and used for in vitro and in vivo experiments.

TABLE 9 mRNA constructs used in the present examples

| RNA ID | Antigen Name | 5'-UTR/3'-UTR; UTR Design | 3'-terminal Elements (3'-end) | SEQ ID NO: RNA | SEQ ID NO: Protein |
|---|---|---|---|---|---|
| R6939/R7003 | F0 | —/muag; i-3 | A64-N5-C30-histoneSL-N5 | 475 | 68 |
| R3737/R3938 | F0 | RPL32/ALB7; i-2 | A64-N5-C30-histoneSL-N5 | 466 | 68 |
| R6940 | F-del | —/muag; i-3 | A64-N5-C30-histoneSL-N5 | 890 | 483 |
| R3738/R3939 | F-del | RPL32/ALB7; i-2 | A64-N5-C30-histoneSL-N5 | 881 | 483 |
| R6808 | F0_DSCav1 | —/muag; i-3 | A64-N5-C30-histoneSL-N5 | 1259 | 898 |
| R5453 | F-del_DSCav1 | —/muag; i-3 | A64-N5-C30-histoneSL-N5 | 1628 | 1267 |
| R6122 | F-del_DSCav1 | RPL32/ALB7; i-2 | A64-N5-C30-histoneSL-N5 | 1620 | 1267 |
| R4745/R5717 | F-del_DSCav1 | HSD17B4/ALB7; i-4 | A64-N5-C30-histoneSL-N5 | 8278 | 1267 |
| R6771 | F_DSCav1_mut1 | —/muag; i-3 | A64-N5-C30-histoneSL-N5 | 1997 | 1636 |
| R6774 | F-del_DSCav1_mut1 | —/muag; i-3 | A64-N5-C30-histoneSL-N5 | 2366 | 2005 |
| R6772 | F_DSCav1_mut2 | —/muag; i-3 | A64-N5-C30-histoneSL-N5 | 2735 | 2374 |
| R6773 | F-del_DSCav1_mut2 | —/muag; i-3 | A64-N5-C30-histoneSL-N5 | 3104 | 2743 |
| R6770 | F_DSCav1_mut3 | —/muag; i-3 | A64-N5-C30-histoneSL-N5 | 3473 | 3112 |
| R6775 | F-del_DSCav1_mut3 | —/muag; i-3 | A64-N5-C30-histoneSL-N5 | 3842 | 3481 |
|  | F-del_DSCav1 | HSD17B4/PSMB3; a-1 | A64-N5-C30-histoneSL-N5 | 1276 | 1267 |
|  | F-del_DSCav1 | Ndufa4/PSMB3; a-2 | A64-N5-C30-histoneSL-N5 | 1284 | 1267 |
|  | F-del_DSCav1 | Slc7a3/PSMB3; a-3 | A64-N5-C30-histoneSL-N5 | 1292 | 1267 |
|  | F-del_DSCav1 | Nosip/PSMB3; a-4 | A64-N5-C30-histoneSL-N5 | 1300 | 1267 |
|  | F-del_DSCav1 | Mp68/PSMB3; a-5 | A64-N5-C30-histoneSL-N5 | 1308 | 1267 |
|  | F-del_DSCav1 | Ubqln2/RPS9; b-1 | A64-N5-C30-histoneSL-N5 | 1316 | 1267 |
|  | F-del_DSCav1 | ASAH1/RPS9; b-2 | A64-N5-C30-histoneSL-N5 | 1324 | 1267 |
|  | F-del_DSCav1 | HSD17B4/RPS9; b-3 | A64-N5-C30-histoneSL-N5 | 1332 | 1267 |
|  | F-del_DSCav1 | HSD17B4/CASP1; b-4 | A64-N5-C30-histoneSL-N5 | 1340 | 1267 |
|  | F-del_DSCav1 | Nosip/COX6B1; b-5 | A64-N5-C30-histoneSL-N5 | 1348 | 1267 |
|  | F-del_DSCav1 | Ndufa4/RPS9; c-1 | A64-N5-C30-histoneSL-N5 | 1356 | 1267 |
|  | F-del_DSCav1 | Nosip/Ndufa1; c-2 | A64-N5-C30-histoneSL-N5 | 1364 | 1267 |
|  | F-del_DSCav1 | Ndufa4/COX6B1; c-3 | A64-N5-C30-histoneSL-N5 | 1372 | 1267 |
|  | F-del_DSCav1 | Ndufa4/Ndufa1; c-4 | A64-N5-C30-histoneSL-N5 | 1380 | 1267 |
|  | F-del_DSCav1 | ATP5A1/PSMB3; c-5 | A64-N5-C30-histoneSL-N5 | 1388 | 1267 |
|  | F-del_DSCav1 | Rpl31/PSMB3; d-1 | A64-N5-C30-histoneSL-N5 | 1396 | 1267 |
|  | F-del_DSCav1 | ATP5A1/CASP1; d-2 | A64-N5-C30-histoneSL-N5 | 1404 | 1267 |
|  | F-del_DSCav1 | Slc7a3/Gnas; d-3 | A64-N5-C30-histoneSL-N5 | 1412 | 1267 |
|  | F-del_DSCav1 | HSD17B4/Ndufa1; d-4 | A64-N5-C30-histoneSL-N5 | 1420 | 1267 |
|  | F-del_DSCav1 | Slc7a3/Ndufa1; d-5 | A64-N5-C30-histoneSL-N5 | 1428 | 1267 |
|  | F-del_DSCav1 | TUBB4B/RPS9; e-1 | A64-N5-C30-histoneSL-N5 | 1436 | 1267 |
|  | F-del_DSCav1 | Rpl31/RPS9; e-2 | A64-N5-C30-histoneSL-N5 | 1444 | 1267 |
|  | F-del_DSCav1 | Mp68/RPS9; e-3 | A64-N5-C30-histoneSL-N5 | 1452 | 1267 |
|  | F-del_DSCav1 | Nosip/RPS9; e-4 | A64-N5-C30-histoneSL-N5 | 1460 | 1267 |
|  | F-del_DSCav1 | ATP5A1/RPS9; e-5 | A64-N5-C30-histoneSL-N5 | 1468 | 1267 |
|  | F-del_DSCav1 | ATP5A1/COX6B1; e-6 | A64-N5-C30-histoneSL-N5 | 1476 | 1267 |
|  | F-del_DSCav1 | ATP5A1/Gnas; f-1 | A64-N5-C30-histoneSL-N5 | 1484 | 1267 |
|  | F-del_DSCav1 | ATP5A1/Ndufa1; f-2 | A64-N5-C30-histoneSL-N5 | 1492 | 1267 |
|  | F-del_DSCav1 | HSD17B4/COX6B1; f-3 | A64-N5-C30-histoneSL-N5 | 1500 | 1267 |
|  | F-del_DSCav1 | HSD17B4/Gnas; f-4 | A64-N5-C30-histoneSL-N5 | 1508 | 1267 |
|  | F-del_DSCav1 | Mp68/COX6B1; f-5 | A64-N5-C30-histoneSL-N5 | 1516 | 1267 |
|  | F-del_DSCav1 | Mp68/Ndufa1; g-1 | A64-N5-C30-histoneSL-N5 | 1524 | 1267 |

TABLE 9-continued mRNA constructs used in the present examples

| RNA ID | Antigen Name | 5'-UTR/3'-UTR; UTR Design | 3'-terminal Elements (3'-end) | SEQ ID NO: RNA | SEQ ID NO: Protein |
|---|---|---|---|---|---|
| | F-del_DSCav1 | Ndufa4/CASP1; g-2 | A64-N5-C30-histoneSL-N5 | 1532 | 1267 |
| | F-del_DSCav1 | Ndufa4/Gnas; g-3 | A64-N5-C30-histoneSL-N5 | 1540 | 1267 |
| | F-del_DSCav1 | Nosip/CASP1; g-4 | A64-N5-C30-histoneSL-N5 | 1548 | 1267 |
| | F-del_DSCav1 | Rpl31/CASP1; g-5 | A64-N5-C30-histoneSL-N5 | 1556 | 1267 |
| | F-del_DSCav1 | Rpl31/COX6B1; h-1 | A64-N5-C30-histoneSL-N5 | 1564 | 1267 |
| | F-del_DSCav1 | Rpl31/Gnas; h-2 | A64-N5-C30-histoneSL-N5 | 1572 | 1267 |
| | F-del_DSCav1 | Rpl31/Ndufa1; h-3 | A64-N5-C30-histoneSL-N5 | 1580 | 1267 |
| | F-del_DSCav1 | Slc7a3/CASP1; h-4 | A64-N5-C30-histoneSL-N5 | 1588 | 1267 |
| | F-del_DSCav1 | Slc7a3/COX6B1; h-5 | A64-N5-C30-histoneSL-N5 | 1596 | 1267 |
| | F-del_DSCav1 | Slc7a3/RPS9; i-1 | A64-N5-C30-histoneSL-N5 | 1604 | 1267 |
| | F-del_DSCav1 | RPL32(32L4)/ALB7; i-2 | A64-N5-C30-histoneSL-N5 | 1612 | 1267 |
| R7454 | F_DSCav1_mut0 | —/muag; i-3 | A64-N5-C30-histoneSL-N5 | 4211 | 3850 |
| R7455 | F-del_DSCav1_mut0 | —/muag; i-3 | A64-N5-C30-histoneSL-N5 | 4580 | 4219 |
| R7458 | F_DSCav1_mut4 | —/muag; i-3 | A64-N5-C30-histoneSL-N5 | 4949 | 4588 |
| R7459 | F-del_DSCav1_mut4 | —/muag; i-3 | A64-N5-C30-histoneSL-N5 | 5318 | 4957 |
| R7456 | F_DSCav1_mut5 | —/muag; i-3 | A64-N5-C30-histoneSL-N5 | 5687 | 5326 |
| R7457 | F-del_DSCav1_mut5 | —/muag; i-3 | A64-N5-C30-histoneSL-N5 | 6056 | 5695 |
| | F_DSCav1_mut6 | —/muag; i-3 | A64-N5-C30-histoneSL-N5 | 6425 | 6064 |
| | F-del_DSCav1_mut6 | —/muag; i-3 | A64-N5-C30-histoneSL-N5 | 6794 | 6433 |
| | F_DSCav1_mut7 | —/muag; i-3 | A64-N5-C30-histoneSL-N5 | 7163 | 6802 |
| | F-del_DSCav1_mut7 | —/muag; i-3 | A64-N5-C30-histoneSL-N5 | 7532 | 7171 |
| | F_DSCav1_mut8 | —/muag; i-3 | A64-N5-C30-histoneSL-N5 | 7901 | 7540 |
| | F-del_DSCav1_mut8 | —/muag; i-3 | A64-N5-C30-histoneSL-N5 | 8270 | 7909 |
| R7595 | M | —/muag; i-3 | A64-N5-C30-histoneSL-N5 | 10046 | 9684 |
| R7597 | N | —/muag; i-3 | A64-N5-C30-histoneSL-N5 | 10496 | 10134 |
| R7598 | M2-1 | —/muag; i-3 | A64-N5-C30-histoneSL-N5 | 11545 | 11183 |
| R7596 | P | —/muag; i-3 | A64-N5-C30-histoneSL-N5 | 10999 | 10637 |

1.4. Preparation of an LNP Formulated mRNA Composition:

Lipid nanoparticles (LNP), cationic lipids, and polymer conjugated lipids (PEG-lipid) were prepared and tested essentially according to the general procedures described in WO2015/199952, WO2017/004143 and WO2017/075531, the full disclosures of which are incorporated herein by reference. LNP formulated mRNA was prepared using an ionizable amino lipid (cationic lipid), phospholipid, cholesterol and a PEGylated lipid. Briefly, cationic lipid compound of formula III-3, DSPC, cholesterol, and PEG-lipid of formula IVa were solubilized in ethanol at a molar ratio (%) of approximately 50:10:38.5:1.5 or 47.4:10:40.9:1.7. LNPs comprising cationic lipid compound of formula III-3 and PEG-lipid compound of formula IVa were prepared at a ratio of mRNA to total Lipid of 0.03-0.04 w/w. The mRNA was diluted to 0.05 mg/mL to 0.2 mg/mL in 10 mM to 50 mM citrate buffer, pH4. Syringe pumps were used to mix the ethanolic lipid solution with the mRNA aqueous solution at a ratio of about 1:5 to 1:3 (vol/vol) with total flow rates above 15 ml/min. The ethanol was then removed and the external buffer replaced with a PBS buffer comprising Sucrose by dialysis. Finally, the lipid nanoparticles were filtered through a 0.2 um pore sterile filter and the LNP-formulated mRNA composition was adjusted to about 1 mg/ml total mRNA. Lipid nanoparticle particle diameter size was 60-90 nm as determined by quasi-elastic light scattering using a Malvern Zetasizer Nano (Malvern, UK). For other cationic lipid compounds mentioned in the present specification, the formulation process is essentially similar. The obtained LNP-formulated mRNA composition (1 mg/ml total mRNA) was diluted to the desired target concentration using Saline before in vivo application.

1.5. Preparation of a Protamine Complexed mRNA Composition:

mRNA constructs were complexed with protamine prior to use in in vivo immunization experiments. The mRNA formulation consisted of a mixture of 50% free mRNA and 50% mRNA complexed with protamine at a weight ratio of 2:1. First, mRNA was complexed with protamine by addition of protamine-Ringer's lactate solution to mRNA. After incubation for 10 minutes, when the complexes were stably generated, free mRNA was added, and the final concentration was adjusted with Ringer's lactate solution.

Example 2: Vaccination of Cotton Rats with LNP-Formulated mRNA Encoding RSV-F and RSV Cotton Rat Challenge Study The present Example shows that LNP-formulated mRNA encoding RSV-F induces strong and functional immune responses in cotton rats.

For the development of RSV vaccines the cotton rat is an accepted animal model, especially for the challenge infection. Cotton rats that have received formalin-inactivated RSV virus vaccine preparations respond to RSV infection with enhanced lung pathology. This allows the evaluation of the safety of a vaccination in terms of enhanced disease phenomenon.

To optimize the RSV-specific immune response, mRNA vaccines encoding the pre-fusion stabilized RSV F protein F-del_DSCav were prepared according to Example 1, formulated either with LNPs (see Example 1.4.) or with protamine (see Example 1.5.) and were applied on days 0 and 28 intramuscularly (i.m.) or intradermally (i.d) with different doses of RNA as shown in Table 10. Control animals received a single vaccination at day 0 with 105 pfu live RSV/A2 virus intranasally or two vaccinations at days 0 and 28 with formalin-inactivated RSV virus (FI-RSV) intramuscularly. Additional control animals received buffer only. For the present example, a UTR combination HSD17B4/ALB7 was used, herein referred to as "i-4".

TABLE 10

Animal groups and vaccination schedule of Example 2

| Group | Cotton rats | Treatment | mRNA | dose | Route | Volume |
|---|---|---|---|---|---|---|
| 1 | 5 | mRNA/LNP | R4745 | 10 µg | i.m. | 1 × 100 uL |
| 2 | 5 | mRNA/LNP | R4745 | 2 µg | i.m. | 1 × 100 uL |
| 3 | 5 | mRNA/LNP | R4745 | 10 µg | i.d. | 2 × 50 uL |
| 4 | 5 | mRNA/LNP | R4745 | 2 µg | i.d. | 2 × 50 uL |
| 5 | 5 | mRNA/protamine | R5717 | 80 µg | i.m. | 1 × 100 uL |
| 6 | 5 | mRNA/protamine | R5717 | 80 µg | i.d. | 2 × 50 uL |
| 7 | 5 | Live RSV/A2 virus | | 105 pfu | i.n. | 1 × 100 uL |
| 8 | 5 | FI-RSV | | 1:100 | i.m. | 1 × 100 uL |
| 9 | 5 | Buffer | | — | i.m | 1 × 100 uL |
| 10 | 5 | Untreated/uninfected | | — | — | |

Determination of Virus Neutralization Titers:

Serum was collected at day 49 and RSV virus neutralization titers (VNTs) were measured using a plaque reduction neutralization test (PRNT). Diluted serum samples were incubated with RSV/A2 for 1 hour at room temperature and inoculated in duplicates onto confluent HEp-2 monolayers in 24 well plates. After one hour incubation at 370C in a 5% CO2 incubator, the wells were overlayed with 0.75% Methylcellulose medium. After 4 days of incubation, the overlays were removed and the cells were fixed and stained. The corresponding reciprocal neutralizing antibody titers were determined at the 60% reduction end-point of the virus control.

Cotton Rat Challenge Study:

The vaccinated animals were challenged intranasally at day 63 with 105 pfu live RSV/A2 virus in 100 uL. One control group remained untreated and uninfected (group 10). All animals were sacrificed at day 68 and nasal tissue and lung were harvested.

RSV Titers in the Lungs of Challenged Cotton Rats:

Lungs of animals were collected at day 68 (i.e. 5 days after intranasal challenge with 105 pfu live RSV/A2 virus) and RSV/A2 titers were quantified in one lobe by plaque assay. Lung homogenates were clarified by centrifugation and diluted in EMEM. Confluent HEp-2 monolayers were infected in duplicates with diluted homogenates in 24 well plates. After one hour incubation at 37° C. in a 5% CO incubator, the wells were overlayed with 0.75% methylcellulose medium. After 4 days of incubation, the overlays were removed and the cells were fixed and stained with 0.1% crystal violet for one hour and then rinsed and air dried. Plaques were counted and virus titers were expressed as plaque forming units per gram of tissue. Viral titers were calculated as geometric mean±standard error for all animals in a group at a given time.

Lung Histopathology of Challenged Cotton Rats:

Lungs of animals were collected at day 68 (i.e. 5 days after intranasal challenge with 105 pfu live RSV/A2 virus) and one lobe was analyzed by histopathology. Lungs were dissected and inflated with 10% neutral buffered formalin to their normal volume, and then immersed in the same fixative solution. Following fixation, the lungs were embedded in paraffin, sectioned and stained with hematoxylin and eosin (H&E). Four parameters of pulmonary inflammation were evaluated: peribronchiolitis (inflammatory cell infiltration around the bronchioles), perivasculitis (inflammatory cell infiltration around the small blood vessels), interstitial pneumonia (inflammatory cell infiltration and thickening of alveolar walls), and alveolitis (cells within the alveolar spaces). Slides were scored blindly on a 0-4 severity scale. The scores were subsequently converted to a 0-100% histopathology scale.

Results:

As can be seen from FIG. 1, the LNP formulated RSV-F (F-del_DSCav1) mRNA vaccines induce the formation of RSV specific functional antibodies in cotton rats as shown by high virus neutralizing antibody titers (groups 1-4). Vaccination with protamine-formulated mRNA induces only weak responses.

Figure 2:
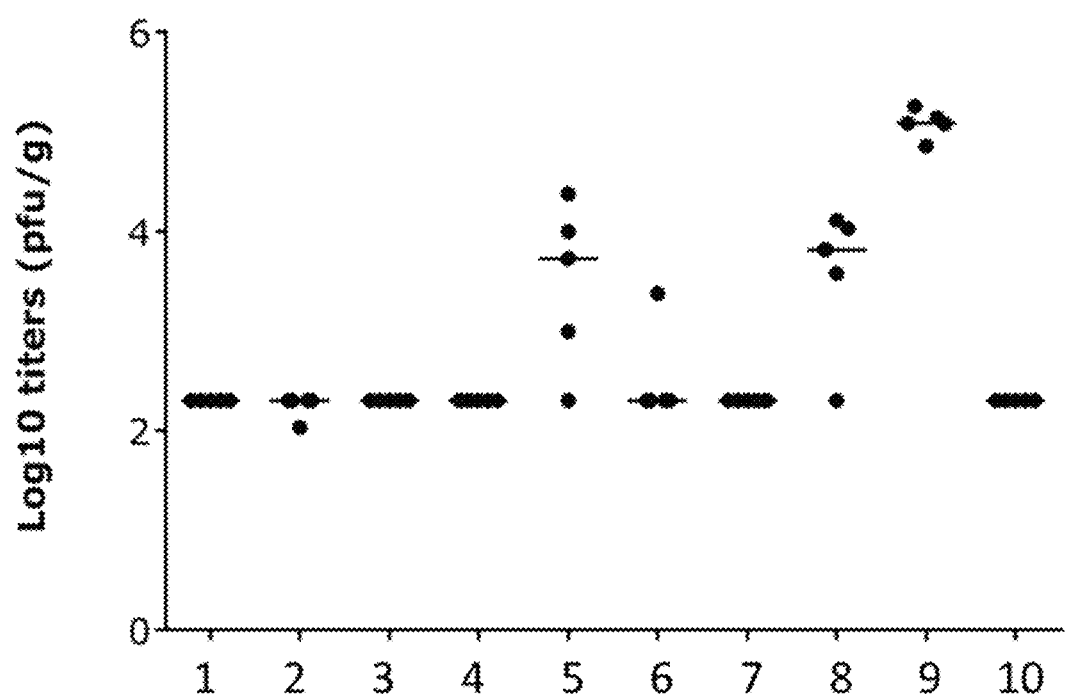
FIG. 2 shows that LNP-formulated mRNA encoding RSV F-protein (F-del_DSCav1) reduces RSV infection of the lung in cotton rats after i.m. and i.d. vaccination. Vaccination schedule see Table 10. Further details are provided in Example 2.

As can be seen from FIG. 2, the LNP-formulated RSV-F (F-del_DSCav1) mRNA vaccines reduce lung viral titers in cotton rats challenged with RSV virus and therefore limit RSV infection of the lung (groups 1-4). All the animal groups vaccinated with mRNA formulated in LNPs vaccines showed virus titers below the level of detection of the performed virus titration demonstrating protection of vaccinated cotton rats in terms of viral lung titers. By contrast, the protamine-formulated mRNA vaccines (administrated i.m.) and the Formalin-inactivated virus vaccine reduced only minimally the lung virus titer compared to the buffer control group.

Figure 3:
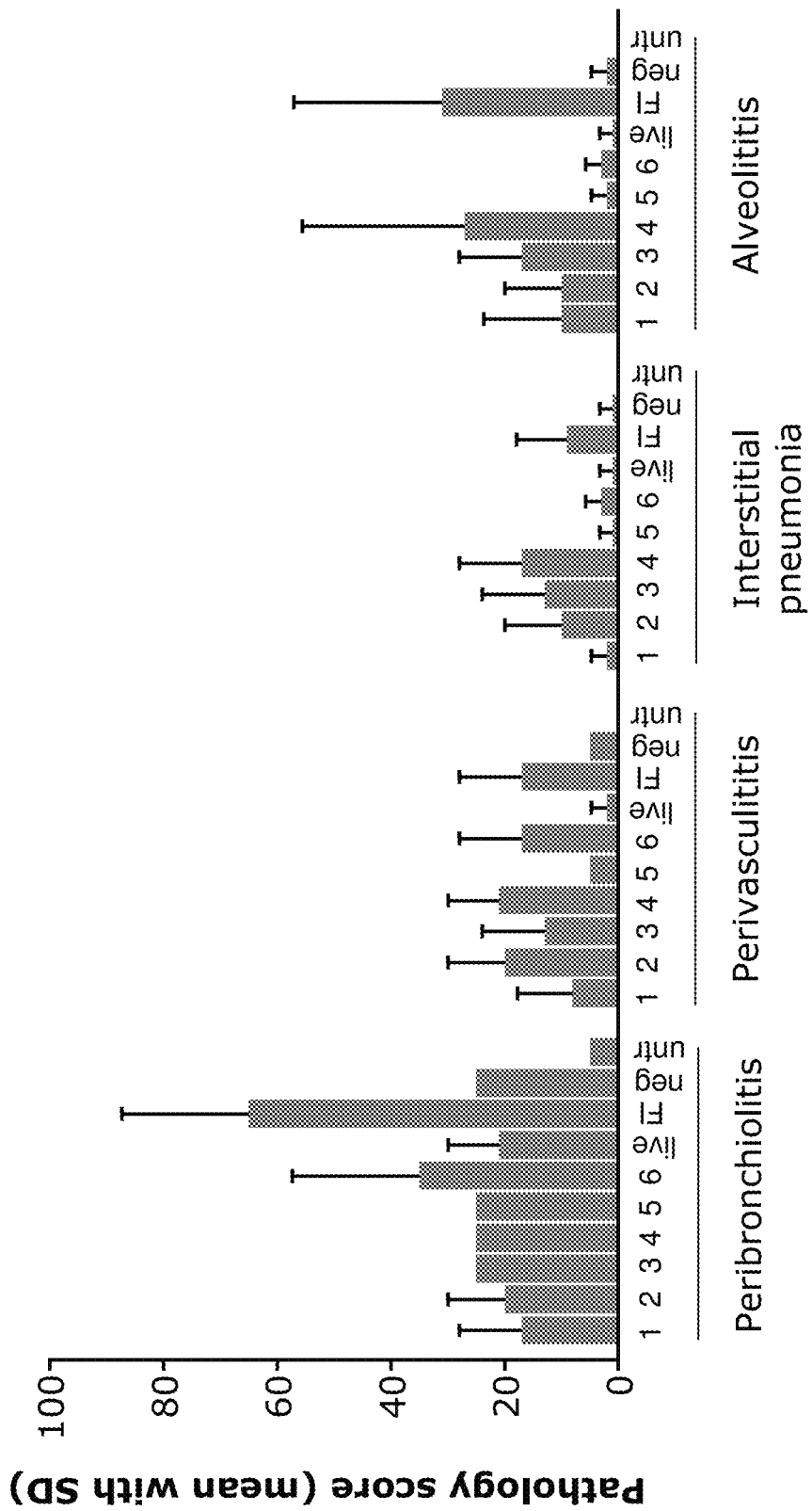
FIG. 3 shows the results of a lung histopathology analysis from the RSV cotton rat challenge study described in Example 2. Animals vaccinated with LNP-formulated mRNA do not show increased lung histopathology/enhanced inflammation after viral challenge in contrast to the vaccination with formalin-inactivated RSV virus vaccine. Vaccination schedule see Table 10. Further details are provided in Example 2.

As can be seen from FIG. 3, the lung histopathology analysis from the RSV cotton rat challenge study reveals different pathology scores for the various animal groups. From the histopathology it can be concluded that none of the mRNA vaccinated groups displayed enhanced lung pathology as it is the case for the group that was vaccinated using the formalin-inactivated RSV vaccine. The average pathology scores for peribronchiolitis, perivasculitis, interstitial pneumonia and alveolitis are much lower for all groups vaccinated with mRNA (groups 1-6) compared to the group with formalin-inactivated RSV (group 8).

Example 3: Vaccination of Cotton Rats with LNP-Formulated mRNA Encoding RSV-F and RSV Cotton Rat Challenge Study The present Example shows that LNP-formulated mRNA encoding different RSV-F antigens induce strong and functional immune responses in cotton rats for mRNA constructs having UTR combination RPL32/ALB7 (i-2).

This experiment compared mRNA-LNPs encoding three different RSV-F variants: full-length RSV F0, truncated RSV F-del, and pre-fusion stabilized truncated F-del_D-SCav1. The mRNA-LNP vaccines were prepared according to Example 1. Cotton rats received two intramuscular vaccinations with mRNA-LNP vaccines on days 0 and 28. Each dose comprised 10 µg or 100 µg mRNA-LNPs. Control animals received a single vaccination at day 0 with 105 pfu live RSV/A2 virus intranasally or two vaccinations at days 0 and 28 with formalin-inactivated RSV virus (FI RSV) intramuscularly. Additional control animals received buffer only (see Table 11).

TABLE 11

Animal groups and vaccination schedule of Example 3

| Group | Test item | RNA ID | Dose | Route |
|---|---|---|---|---|
| 1 | mRNA encoding F0 LNP-formulated | R3737 | 10 µg | i.m. |
| 2 | mRNA encoding F0 LNP-formulated | R3737 | 100 µg | i.m. |
| 3 | mRNA encoding F-del LNP-formulated | R3738 | 10 µg | i.m. |
| 4 | mRNA encoding F-del LNP-formulated | R3738 | 100 µg | i.m. |
| 5 | mRNA encoding F-delDSCav1 LNP-formulated | R6122 | 10 µg | i.m. |
| 6 | mRNA encoding F-delDSCav1 LNP-formulated | R6122 | 100 µg | i.m. |
| 7 | Live RSV/A2 virus | | 105 pfu | i.n. |
| 8 | FI RSV | | 1:100 | i.m. |
| 9 | Buffer | | — | i.m. |
| 10 | untreated/uninfected | | — | — |

Determination of Anti-RSV F Protein Antibodies by ELISA:

Blood samples were collected on days 28, 49, and 63 for the determination of anti-RSV F antibody titers. ELISA plates are coated with recombinant human RSV fusion glycoprotein (Extracellular domain of human RSV Fusion glycoprotein (529) fused with a polyhistidine tag at the C-terminus, expressed in Baculovirus-Insect Cells, provided as lyophilized powder). Coated plates are incubated using given serum dilutions. Binding of specific antibodies to the F protein is detected using biotinylated isotype specific anti-mouse antibodies in combination with streptavidin-HRP (horse radish peroxidase) with ABTS substrate.

Determination of Virus Neutralization Titers:

Serum was collected at day 49 and RSV virus neutralization titers (VNTs) were measured using a plaque reduction neutralization test (PRNT). Diluted serum samples were incubated with RSV/A2 for 1 hour at room temperature and inoculated in duplicates onto confluent HEp-2 monolayers in 24 well plates. After one hour incubation at 37° C. in a 5% CO2 incubator, the wells were overlayed with 0.75% Methylcellulose medium. After 4 days of incubation, the overlays were removed and the cells were fixed and stained. The corresponding reciprocal neutralizing antibody titers were determined at the 60% reduction end-point of the virus control.

Cotton Rat Challenge Study:

The vaccinated animals were challenged intranasally at day 63 with $10^5$ pfu live RSV/A2 virus in 100 uL. One control group remained untreated and uninfected. All animals were sacrificed at day 68 and nasal tissue and lung were harvested.

RSV Titers in the Lungs of Challenged Cotton Rats:

Lungs of animals were collected at day 68 (i.e. 5 days after intranasal challenge with $10^5$ pfu live RSV/A2 virus) and RSV/A2 titers were quantified in one lobe by plaque assay as described above.

RSV Titers in Nasal Tissue of Challenged Cotton Rats

Nasal tissue of animals was collected at day 68 (i.e. 5 days after intranasal challenge with 105 pfu live RSV/A2 virus). The nose homogenates were clarified as the lung homogenates by centrifugation and diluted in EMEM. Confluent HEp-2 monolayers were infected in duplicates with diluted homogenates in 24 well plates. After one hour incubation at 37° C. in a 5% CO incubator, the wells were overlayed with 0.75% methylcellulose medium. After 4 days of incubation, the overlays were removed and the cells were fixed and stained with 0.1% crystal violet for one hour and then rinsed and air dried. Plaques were counted and virus titers were expressed as plaque forming units per gram of tissue. Viral titers were calculated as geometric mean±standard error for all animals in a group at a given time.

Lung Histopathology of Challenged Cotton Rats:

Lungs of animals were collected at day 68 (i.e. 5 days after intranasal challenge with 105 pfu live RSV/A2 virus) and one lobe was analyzed by histopathology as described before.

Figure 4:
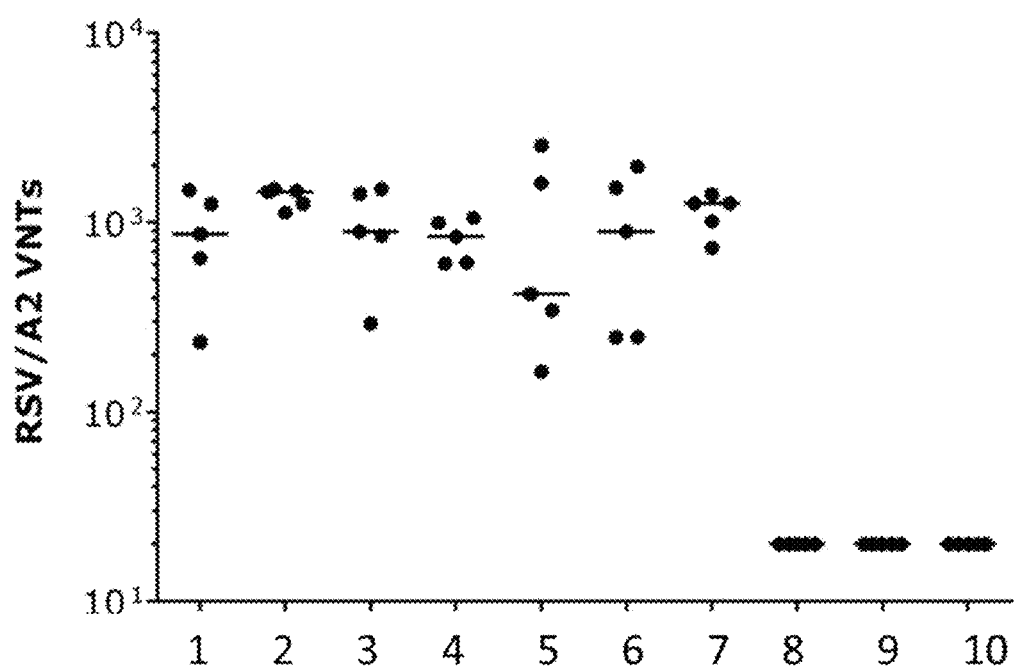
FIG. 4 shows that LNP-formulated mRNA encoding RSV F-protein (F0, F-del, and F-del_DSCav1) induces high (virus neutralization titers) VNTs in the serum of cotton rats after two i.m. vaccinations. VNTs determined performed on day 48. Vaccination schedule see Table 11. Further details are provided in Example 3.

Results:

As can be seen from FIG. 4, all LNP-formulated RSV-F (F0, F-del, F-del_DSCav1) mRNA vaccines induced the formation of RSV specific functional antibodies in cotton rats as shown by high virus neutralizing antibody titers.

Figure 5A:
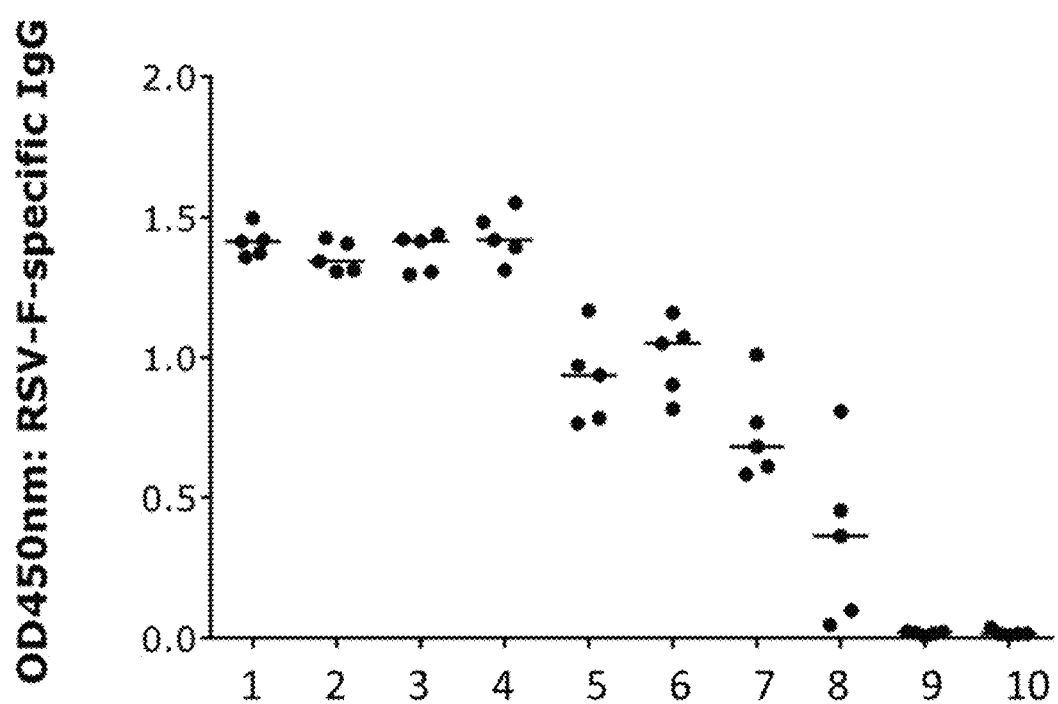
FIGS. 5A-C show that LNP-formulated mRNA encoding RSV F-protein (F0, F-del, and F-del_DSCav1) induces specific humoral immune responses in cotton rats against the RSV-F protein. The experiment was performed as described in Example 3 and antibody total IgG titers were determined by ELISA. RSV-F (formulated in LNP) and RSV-F-del (formulated in LNP) vaccines induce higher titers of RSV-F specific IgGs already after prime vaccination (day 28) than live virus.
Figure 5B:
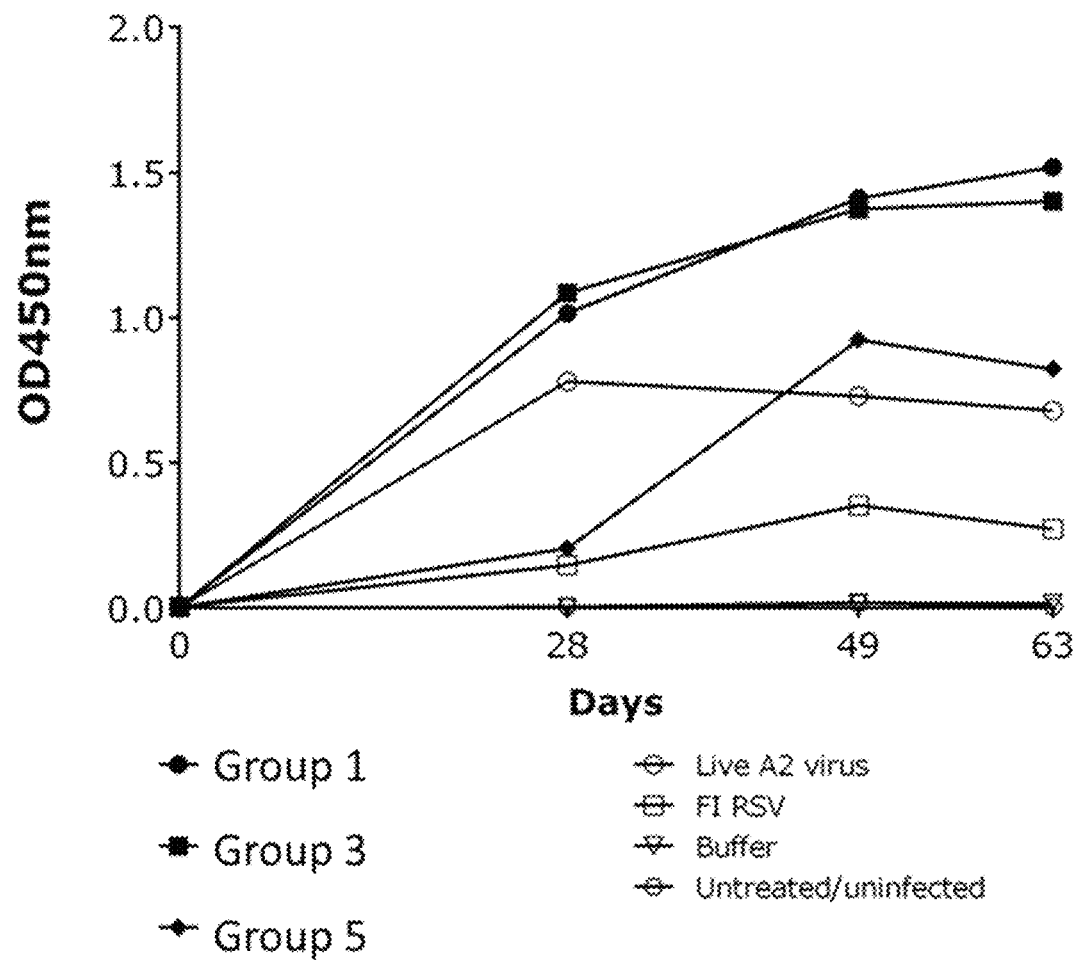
Figure 5C:
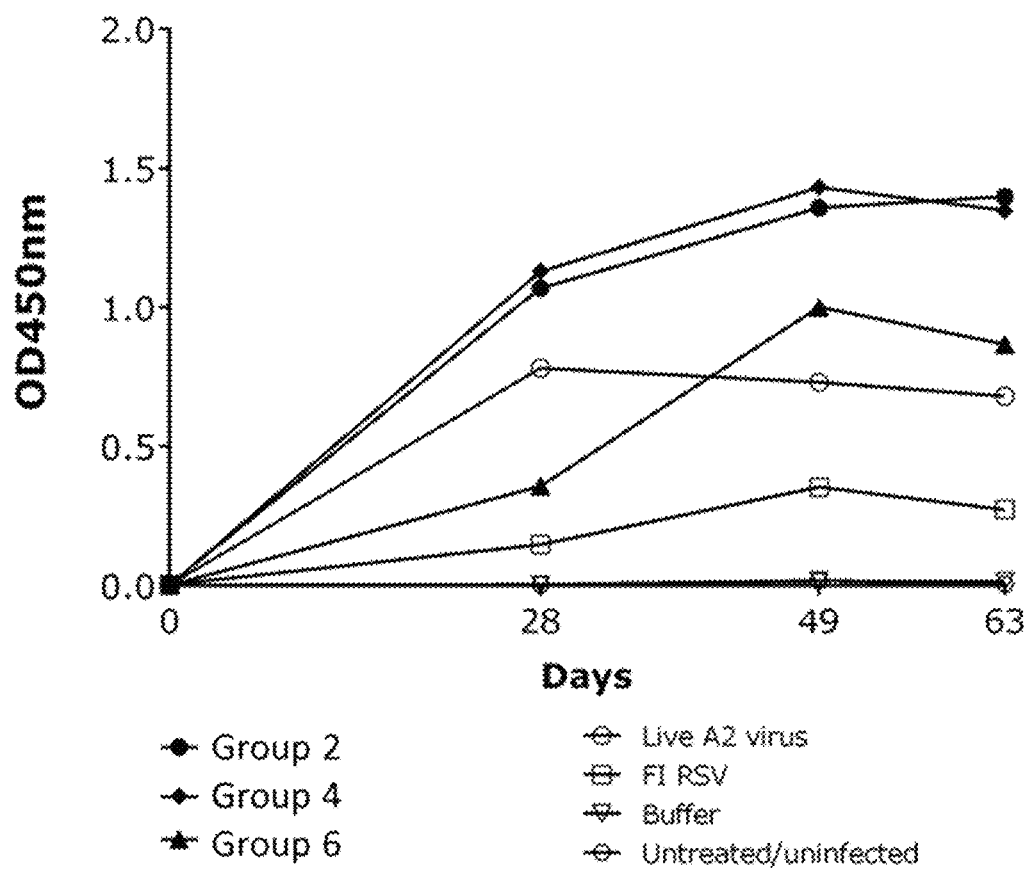

FIGS. 5A, 5B and 5C show that LNP-formulated mRNA encoding the RSV F-protein (F0, F-del, and F-del_DSCav1) induces humoral immune responses in cotton rats against the RSV-F protein. Antibody total IgG titers were determined by ELISA. FIG. 5A: Antibody titers determined on day 49; FIGS. 5B and 5C: time-dependent igG titers in serum with 10 µg mRNA (FIG. 5B) or 100 µg mRNA (FIG. 5C) encoding the RSV F-protein (F0, F-del, and F-del_DSCav1). With both doses, 10 µg and 100 µg, F0 and F-del vaccines induce higher titers of RSV-F specific IgGs already after prime vaccination (day 28) compared with the vaccination with the live virus. After boost vaccination all tested LNP-formulated RSV-F (F0, F-del, F-del_DSCav1) mRNA vaccines induces humoral immune responses measured with ELISA which are more prominent then the answers of the control vaccinations.

Figure 6:
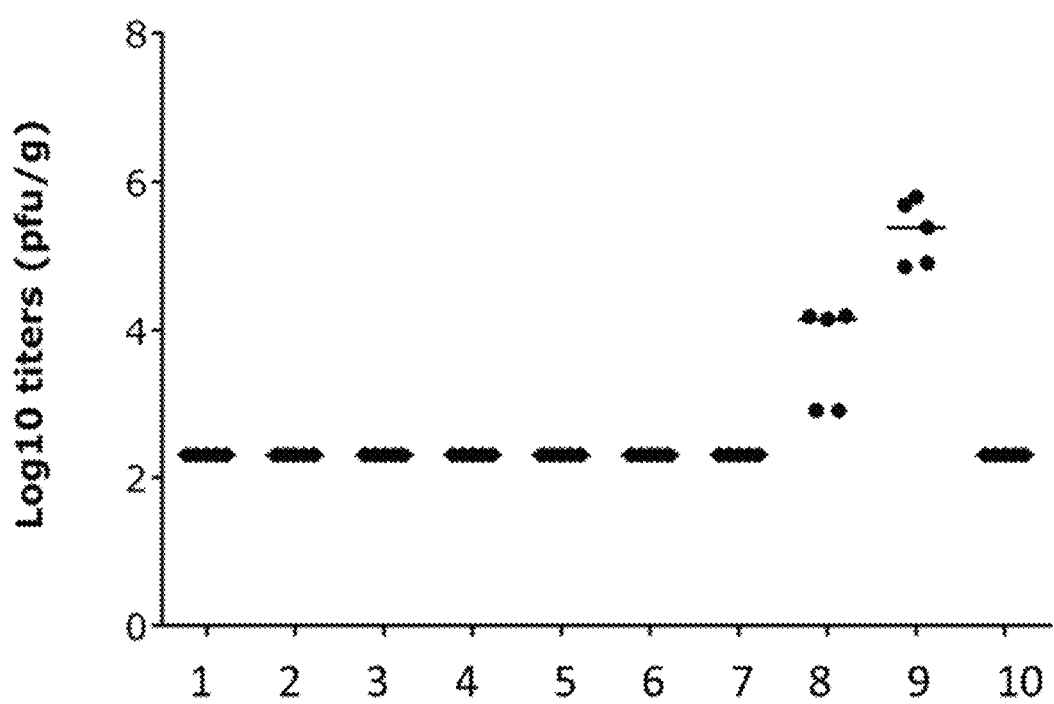
FIG. 6 shows that LNP-formulated mRNA encoding RSV F-protein (F0, F-del, and F-del_DSCav1) reduces RSV infection of the lung in cotton rats after i.m. vaccination. The experiment was performed as described in Example 3. All animal groups vaccinated with mRNA vaccines showed virus titers below the level of detection demonstrating protection of vaccinated cotton rats in terms of viral lung titers. In comparison to the mRNA vaccines the vaccine based on formalin-inactivated virus was not able to prevent virus titers in the lung. Vaccination schedule see Table 11. Further details are provided in Example 3.

As can be seen from FIG. 6, LNP-formulated RSV-F (F0, F-del, F-del_DSCav1) mRNA vaccines reduced lung viral titers in cotton rats challenged with RSV virus and therefore limit RSV infection of the lung. All the animal groups vaccinated with mRNA formulated in LNPs vaccines showed virus titers below the level of detection of the performed virus titration. The results demonstrate protection of vaccinated cotton rats in terms of viral lung titers. By contrast, the formalin-inactivated virus vaccine (FI RSV) reduced only minimally the lung virus titer compared to the buffer control group.

Figure 7:
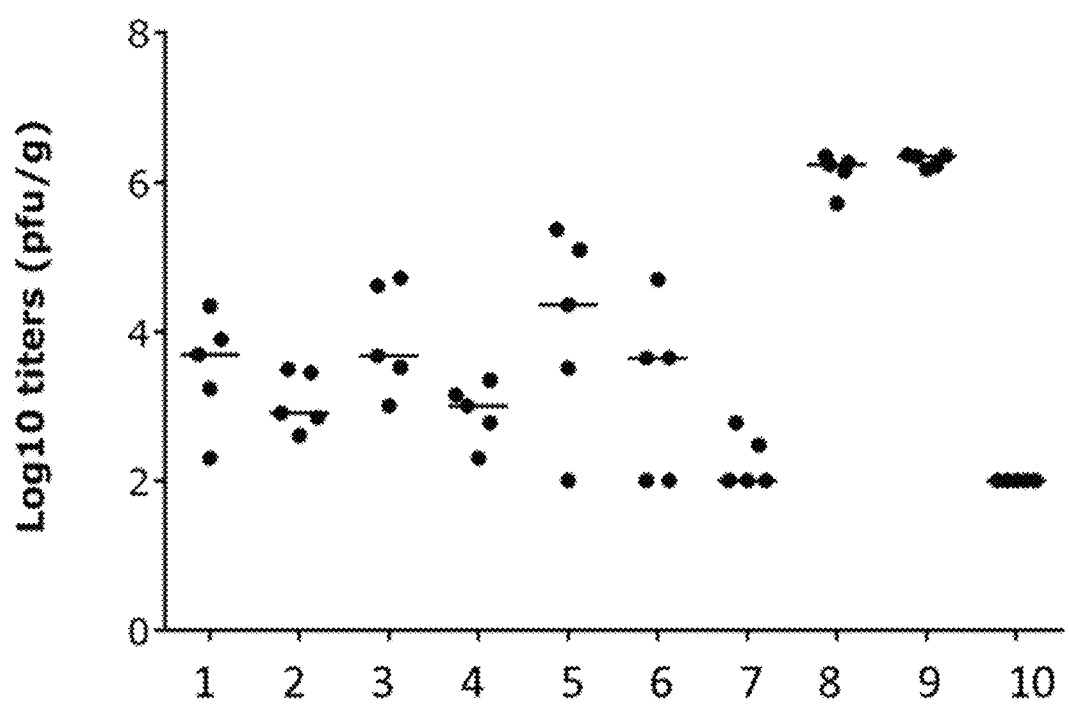
FIG. 7 shows that LNP-formulated mRNA encoding RSV F-protein (F0, F-del, and F-del_DSCav1) reduces RSV titers in the nose of cotton rats after i.m. vaccination. The experiment was performed as described in Example 3. All animal groups vaccinated with mRNA vaccines show strongly reduced viral titers in the nasal tissue in viral challenge infection experiments. In comparison to the mRNA vaccines the vaccine based on formalin-inactivated virus was not able to reduce nasal virus titers. Vaccination schedule see Table 11. Further details are provided in Example 3.

As can be seen from FIG. 7, the LNP-formulated RSV-F (F0, F-del, F-del_DSCav1) mRNA vaccines strongly reduced viral titers in nasal tissue of cotton rats challenged with RSV virus and therefore reduce RSV infection of the nose. In comparison to the mRNA vaccines the vaccine based on formalin-inactivated virus (FI RSV) were not able to reduce the nasal virus titers.

Figure 8:
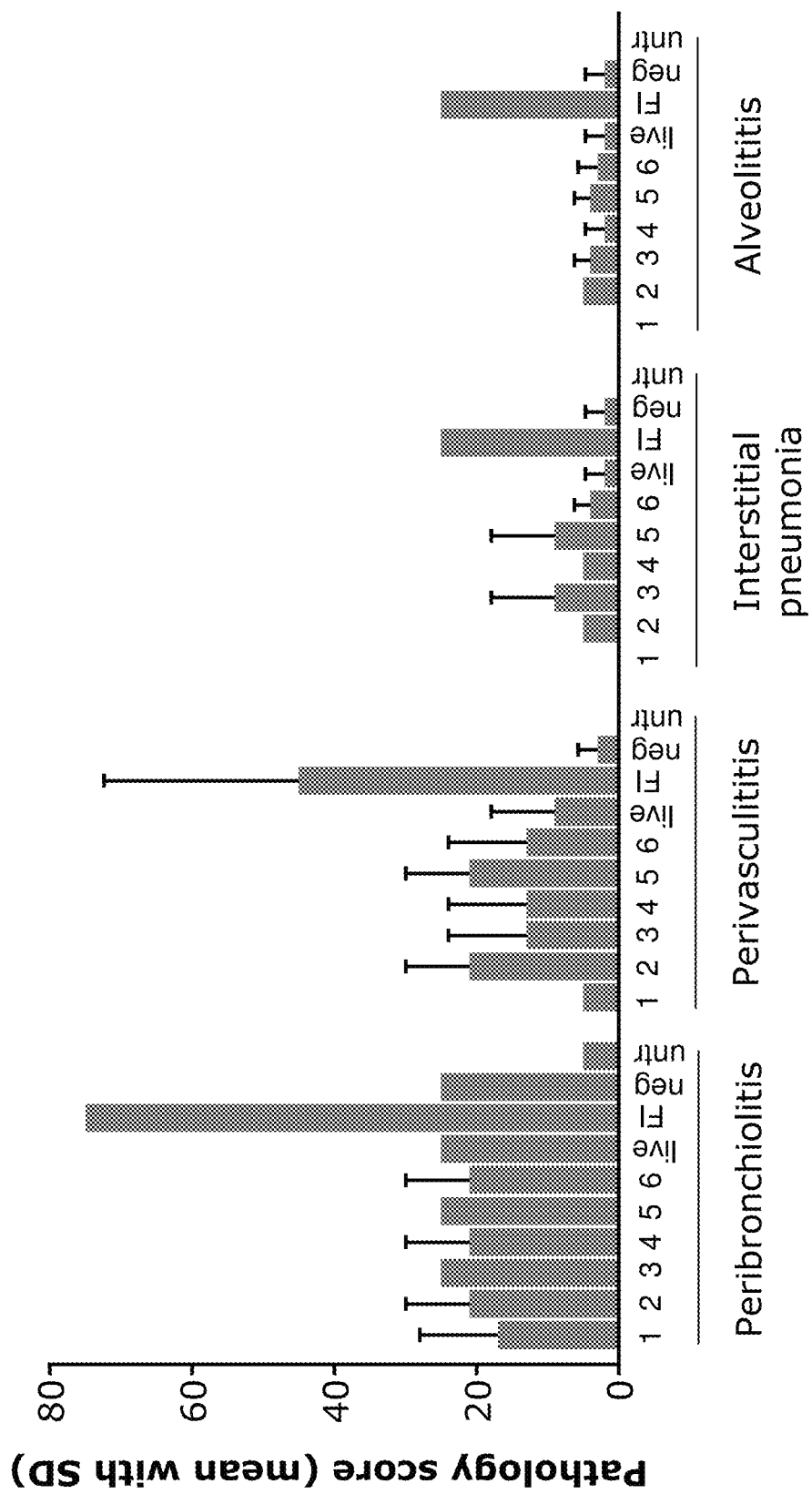
FIG. 8 shows the results of a lung histopathology analysis from the RSV cotton rat challenge study described in Example 3. Animals vaccinated with LNP-formulated mRNA do not show increased lung histopathology/enhanced inflammation after viral challenge in contrast to the vaccination with formalin-inactivated RSV virus vaccine. Vaccination schedule see Table 11. Further details are provided in Example 3.

As can be seen from FIG. 8, the lung histopathology analysis from the RSV cotton rat challenge study reveals different pathology scores for the various animal groups. From the histopathology it can be concluded that none of the mRNA vaccinated groups displayed enhanced lung pathology as it is the case for the group that was vaccinated using the formalin-inactivated RSV vaccine. The average pathology scores for peribronchiolitis, perivasculitis, interstitial pneumonia and alveolitis are much lower for all groups vaccinated with mRNA compared to the group with formalin-inactivated RSV.

To further improve the efficiency of the mRNA-based vaccine, several alternative RSV-F mRNA constructs were designed harboring different UTR combinations to potentially increase translation efficiency of the mRNA. Those mRNA constructs were tested as can be seen in the following Example.

Example 4: In Vitro Expression Screen of RSV-F mRNA Constructs

The present Example shows that the UTR combinations according to the invention strongly improve the expression performance of said mRNA constructs compared to a reference mRNA construct (harboring RPL32/ALB7 UTRs) used e.g. in Example 3 (UTR combination RPL32/ALB7 (i-2)).

To further improve the expression performance of RSV-F mRNA, a screening experiment was conducted to identify advantageous UTR combinations according to the invention. To determine the protein expression performance of RSV-F mRNA constructs comprising different UTR combinations, HEK 293T cells were transfected with different Lipofectamine-formulated mRNA constructs, which all contain the same coding sequence encoding pre-fusion stabilized truncated F-del_DSCav1 but use different 5'- and 3'-UTRs (see Table 12). RSV-F expression was analyzed 24 h after transfection by flow cytometry.

TABLE 12

Overview of mRNA constructs with different UTR combinations used in Example 4

| Antigen | UTR Design | SEQ ID NO: RNA | SEQ ID NO: Protein |
|---|---|---|---|
| F-del_DSCav1 | HSD17B4/PSMB3; a-1 | 1276 | 1267 |
| F-del_DSCav1 | Ndufa4/PSMB3; a-2 | 1284 | 1267 |
| F-del_DSCav1 | Slc7a3/PSMB3; a-3 | 1292 | 1267 |
| F-del_DSCav1 | Nosip/PSMB3; a-4 | 1300 | 1267 |
| F-del_DSCav1 | Mp68/PSMB3; a-5 | 1308 | 1267 |
| F-del_DSCav1 | Ubqln2/RPS9; b-1 | 1316 | 1267 |
| F-del_DSCav1 | ASAH1/RPS9; b-2 | 1324 | 1267 |
| F-del_DSCav1 | HSD17B4/RPS9; b-3 | 1332 | 1267 |
| F-del_DSCav1 | HSD17B4/CASP1; b-4 | 1340 | 1267 |
| F-del_DSCav1 | Nosip/COX6B1; b-5 | 1348 | 1267 |
| F-del_DSCav1 | Ndufa4/RPS9; c-1 | 1356 | 1267 |
| F-del_DSCav1 | Nosip/Ndufa1; c-2 | 1364 | 1267 |
| F-del_DSCav1 | Ndufa4/COX6B1; c-3 | 1372 | 1267 |
| F-del_DSCav1 | Ndufa4/Ndufa1; c-4 | 1380 | 1267 |
| F-del_DSCav1 | ATP5A1/PSMB3; c-5 | 1388 | 1267 |
| F-del_DSCav1 | Rpl31/PSMB3; d-1 | 1396 | 1267 |
| F-del_DSCav1 | ATP5A1/CASP1; d-2 | 1404 | 1267 |
| F-del_DSCav1 | Slc7a3/Gnas; d-3 | 1412 | 1267 |
| F-del_DSCav1 | HSD17B4/Ndufa1; d-4 | 1420 | 1267 |
| F-del_DSCav1 | Slc7a3/Ndufa1; d-5 | 1428 | 1267 |
| F-del_DSCav1 | TUBB4B/RPS9; e-1 | 1436 | 1267 |
| F-del_DSCav1 | Rpl31/RPS9; e-2 | 1444 | 1267 |
| F-del_DSCav1 | Mp68/RPS9; e-3 | 1452 | 1267 |
| F-del_DSCav1 | Nosip/RPS9; e-4 | 1460 | 1267 |
| F-del_DSCav1 | ATP5A1/RPS9; e-5 | 1468 | 1267 |
| F-del_DSCav1 | ATP5A1/COX6B1; e-6 | 1476 | 1267 |
| F-del_DSCav1 | ATP5A1/Gnas; f-1 | 1484 | 1267 |
| F-del_DSCav1 | ATP5A1/Ndufa1; f-2 | 1492 | 1267 |
| F-del_DSCav1 | HSD17B4/COX6B1; f-3 | 1500 | 1267 |
| F-del_DSCav1 | HSD17B4/Gnas; f-4 | 1508 | 1267 |
| F-del_DSCav1 | Mp68/COX6B1; f-5 | 1516 | 1267 |
| F-del_DSCav1 | Mp68/Ndufa1; g-1 | 1524 | 1267 |
| F-del_DSCav1 | Ndufa4/CASP1; g-2 | 1532 | 1267 |
| F-del_DSCav1 | Ndufa4/Gnas; g-3 | 1540 | 1267 |

TABLE 12-continued

Overview of mRNA constructs with different UTR combinations used in Example 4

| Antigen | UTR Design | SEQ ID NO: RNA | SEQ ID NO: Protein |
|---|---|---|---|
| F-del_DSCav1 | Nosip/CASP1; g-4 | 1548 | 1267 |
| F-del_DSCav1 | Rpl31/CASP1; g-5 | 1556 | 1267 |
| F-del_DSCav1 | Rpl31/COX6B1; h-1 | 1564 | 1267 |
| F-del_DSCav1 | Rpl31/Gnas; h-2 | 1572 | 1267 |
| F-del_DSCav1 | Rpl31/Ndufa1; h-3 | 1580 | 1267 |
| F-del_DSCav1 | Slc7a3/CASP1; h-4 | 1588 | 1267 |
| F-del_DSCav1 | Slc7a3/COX6B1; h-5 | 1596 | 1267 |
| F-del_DSCav1 | Slc7a3/RPS9; i-1 | 1604 | 1267 |
| F-del_DSCav1 | RPL32(32L4)/ALB7; i-2 | 1612 | 1267 |

Detailed Description of the Transfection and Flow Cytometry Analysis:

293T cells were seeded at a density of 200000 cells/well (200000 cells/2 ml) in a 6-well plate. Each RNA was complexed with Lipofectamine2000 at a ratio of 1/1.5 (w/v) for 20 minutes in Opti-MEM. Lipocomplexed mRNAs were then added to cells for transfection with 2 µg of RNA per well in a total volume of 500 uL. 4 h post start of transfection the transfection solution was exchanged for 2000 uL/well of complete medium. Cells were further maintained at 37° C., 5% CO2 before performing FACS analysis.

24 hours after transfection, expression of antigen of interest was quantified by FACS analysis using standard procedures. Briefly, cells were detached (40 mM Tris HCl pH 7.5 150 mM NaCl, 1 mM EDTA in H20; 5 min at RT), washed with PBS, and stained on the surface with a mouse antibody against the RSV-F (Millipore, Cat: MAB8262) and a fluorescently labeled goat anti-mouse IgG antibody (Sigma, Cat: F5262). Cells were resuspended in 100 uL PFEA buffer (PBS+2% FCS+2 mM EDTA+0.01% NaN3) and analyzed using a BD FACS Canto II. Live/Dead staining was performed with Aqua fluorescent reactive dye (Invitrogen).

The results were compared to the expression from a reference construct of Example 3 containing the RPL32/ALB7 UTR-combination (SEQ ID NO: 1612) which was set to a level of 100%. The results of the analysis are shown in FIG. 9.

Results

Figure 9:
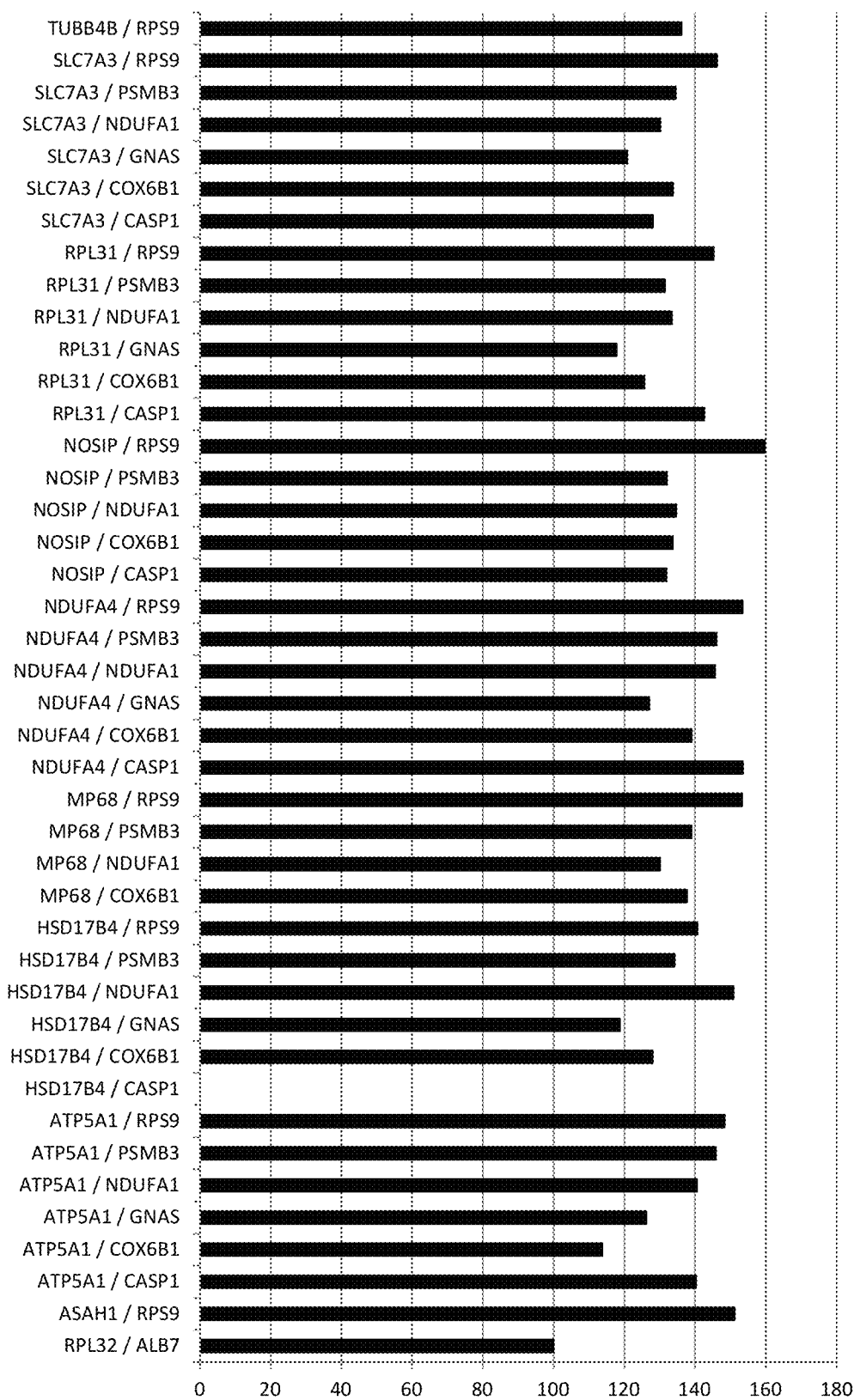
FIG. 9 shows that UTR combinations according to the invention increase the expression of RSV F-Protein in vitro. HEK 293T cells were transfected with different Lipofectamine-formulated mRNA constructs, which all contain the same coding sequence encoding pre-fusion stabilized truncated RSV-F (F-del_DSCav1) but use different combinations of 5' and 3'-UTRs (see Table 12). RSV-F expression was analyzed by flow cytometry. Values show % of the detected RSV-F signal. Values normalized to 100% according to the expression of the reference mRNA construct (UTR combination RPL32/ALB7). Water for injection (WFI) serves as a control. N=2. Further details are provided in Example 4.

As can be seen from FIG. 9, the expression performances of the mRNA constructs comprising UTR combinations according to the invention were strongly increased compared to the construct comprising the reference UTR combination (RPL32/ALB7; i-2).

Example 5: Vaccination of Cotton Rats with LNP-Formulated mRNA Encoding RSV-F and Cotton Rat Challenge Study Based on the results of the UTR screen of Example 4, mRNA constructs having UTR combinations for optimizing mRNA expression are used in vaccination experiments.

In this experiment mRNA vaccines encoding RSV-F (F, F-del, or F-del_DSCav1) with different UTR combinations according to the invention are compared. The mRNA-LNP vaccines are prepared according to Example 1. Cotton rats receive two intramuscular vaccinations with mRNA-LNP vaccines on days 0 and 28. Each dose comprises 2 µg or 10 µg mRNA-LNPs. Control animals receive a single vaccination at day 0 with 105 pfu live RSV/A2 virus intranasally or formalin-inactivated RSV virus intramuscularly. Additional control animals receive buffer only (see Table 13).

TABLE 13

Animal groups and vaccination schedule of Example 5

| Group | Test Item | 5'-UTR/3'-UTR; | SEQ ID NO: RNA | Dose | Route |
|---|---|---|---|---|---|
| 1 | F0, F-del or F-del_DSCav1 | Nosip/RPS9; e-4 | 286, 701 or 1460 | 10 µg | i.m. |
| 2 | F0, F-del or F-del_DSCav1 | Nosip/RPS9; e-4 | 286, 701 or 1460 | 2 µg | i.m. |
| 3 | F0, F-del or F-del_DSCav1 | Ndufa4/CASP1; g-2 | 367, 782 or 1532 | 10 µg | i.m. |
| 4 | F0, F-del or F-del_DSCav1 | Ndufa4/CASP1; g-2 | 367, 782 or 1532 | 2 µg | i.m. |
| 5 | F0, F-del or F-del_DSCav1 | Ndufa4/RPS9; c-1 | 169, 584 or 1356 | 10 µg | i.m. |
| 6 | F0, F-del or F-del_DSCav1 | Ndufa4/RPS9; c-1 | 169, 584 or 1356 | 2 µg | i.m. |
| 7 | F0, F-del or F-del_DSCav1 | Ndufa4/PSMB3; a-2 | 88, 503 or 1284 | 10 µg | i.m. |
| 8 | F0, F-del or F-del_DSCav1 | Ndufa4/PSMB3; a-2 | 88, 503 or 1284 | 2 µg | i.m. |
| 9 | F0, F-del or F-del_DSCav1 | HSD17B4/PSMB3; a-1 | 79, 494 or 1276 | 10 µg | i.m. |
| 10 | F0, F-del or F-del_DSCav1 | HSD17B4/PSMB3; a-1 | 79, 494 or 1276 | 2 µg | i.m. |
| 11 | F0, F-del or F-del_DSCav1 | —/muag; i-3 | 475, 890 or 1628 (R6939, R6940 or R5453) | 10 µg | i.m. |
| 12 | F0, F-del or F-del_DSCav1 | —/muag; i-3 | 475, 890 or 1628 (R6939, R6940 or R5453) | 2 µg | i.m. |
| 13 | Live RSV/A2 virus | | | 5.0Log IM | i.n. |
| 14 | UV-Inact. RSV/A2 | | | 5.0Log IM | i.m. |
| 15 | FI-RSV | | | 1:100 | i.m. |
| 16 | Buffer | | | | i.m. |
| 17 | untreated/uninfected | | | | |

Determination of Anti-RSV Immune Responses Using ELISA or PRNT

The induction of anti-RSV immune responses are determined as described before.

Cotton Rat Challenge Study

The vaccinated animals are challenged intranasally at day 63 with 10exp5 pfu live RSV/A2 virus in 100 uL. One control group remains untreated and uninfected. All animals are sacrificed at day 68 and nasal tissue and lung tissue are harvested.

RSV Titers in the Lungs of Challenged Cotton Rats

Lungs of animals are collected at day 68 (i.e. 5 days after intranasal challenge with 10exp5 pfu live RSV/A2 virus) and RSV/A2 titers are quantified in one lobe by plaque assay as described above. In addition, RSV viral genome copy numbers (by measuring copy numbers of the RSV NS-1 gene) and cytokine mRNA levels were determined by quantitative reverse transcription polymerase chain reaction (qRT-PCR).

RSV Titers in Nasal Tissue of Challenged Cotton Rats

Nasal tissue of animals are collected at day 68 (i.e. 5 days after intranasal challenge with 105 pfu live RSV/A2 virus). The viral titers are quantified as described above. In addition, RSV viral genome copy numbers (by measuring copy numbers of the RSV NS-1 gene) and cytokine mRNA levels were determined by quantitative reverse transcription polymerase chain reaction (qRT-PCR).

Lung Histopatholoqy of Challenged Cotton Rats

Lungs of animals are collected at day 68 (i.e. 5 days after intranasal challenge with 105 pfu live RSV/A2 virus) and one lobe is analyzed by histopathology as described before.

Example 6: Vaccination of Cotton Rats with LNP-Formulated mRNA Encoding RSV-F and Cotton Rat Challenge Study In this experiment mRNA vaccines encoding RSV-F (F_DSCav1_mut1, F_DSCav1_mut2, F_DSCav1_mut3, F-del_DSCav1_mut1, F-del_DSCav1_mut2, F-del_DSCav1_mut3 (and/or additionally with F_DSCav1_mut0, _mut4, _mut5, _mut6, _mut7, _mut8 and/or F-del_DSCav1_mut0, _mut4, _mut5, _mut6, _mut7, _mut8) are compared. The mRNA-LNP vaccines are prepared according to Example 1. Cotton rats receive two intramuscular vaccinations with mRNA-LNP vaccines on days 0 and 28. Each dose comprises 2 µg or 10 µg mRNA-LNPs. Control animals receive a single vaccination at day 0 with 105 pfu live RSV/A2 virus intranasally or formalin-inactivated RSV virus intramuscularly. Additional control animals receive buffer only (see Table 14).

TABLE 14

Animal groups of Example 6

| Group | Test Item | RNA ID | SEQ ID NO: RNA | SEQ ID NO: Protein | Route |
|---|---|---|---|---|---|
| 1 | F_DSCav1_mut1 | R6771 | 1997 | 1636 | i.m. |
| 2 | F-del_DSCav1_mut1 | R6774 | 2366 | 2005 | i.m. |
| 3 | F_DSCav1_mut2 | R6772 | 2735 | 2374 | i.m. |
| 4 | F-del_DSCav1_mut2 | R6773 | 3104 | 2743 | i.m. |
| 5 | F_DSCav1_mut3 | R6770 | 3473 | 3112 | i.m. |
| 6 | F-del_DSCav1_mut3 | R6775 | 3842 | 3481 | i.m. |
| 7 | Live RSV/A2 virus | | | | i.n. |
| 8 | UV-Inact. RSV/A2 | | | | i.m. |
| 9 | FI-RSV | | | | i.m. |
| 10 | Buffer | | | | i.m. |
| 11 | Untreated/uninfected | | | | |

Determination of Anti-RSV Immune Responses Using ELISA or PRNT

The induction of anti-RSV immune responses are determined as described before.

Cotton Rat Challenge Study

The vaccinated animals are challenged intranasally at day 63 with 10exp5 pfu live RSV/A2 virus in 100 uL. One control group remains untreated and uninfected. All animals are sacrificed at day 68 and nasal tissue and lung tissue are harvested.

RSV Titers in the Lungs of Challenged Cotton Rats

Lungs of animals are collected at day 68 (i.e. 5 days after intranasal challenge with 10exp5 pfu live RSV/A2 virus) and RSV/A2 titers are quantified in one lobe by plaque assay as described above. In addition, RSV viral genome copy numbers (by measuring copy numbers of the RSV NS-1 gene) and cytokine mRNA levels were determined by quantitative reverse transcription polymerase chain reaction (qRT-PCR).

RSV Titers in Nasal Tissue of Challenged Cotton Rats

Nasal tissue of animals are collected at day 68 (i.e. 5 days after intranasal challenge with 105 pfu live RSV/A2 virus). The viral titers are quantified as described above. In addition, RSV viral genome copy numbers (by measuring copy numbers of the RSV NS-1 gene) and cytokine mRNA levels were determined by quantitative reverse transcription polymerase chain reaction (qRT-PCR).

Lung Histopathology of Challenged Cotton Rats

Lungs of animals are collected at day 68 (i.e. 5 days after intranasal challenge with $10^5$ pfu live RSV/A2 virus) and one lobe is analyzed by histopathology as described before.

Example 7: Vaccination of Cotton Rats with LNP-Formulated mRNA Encoding RSV-F and a Further RSV Antigen and Cotton Rat Challenge Study To broaden and optimize the RSV-specific immune response, especially to increase T-cell dependent immune responses, mRNA vaccines encoding different RSV proteins (RSV F (F, F, F-del, F_DSCav1 F-del_DSCav1, or F_DSCav1 mut0-mut8 or F-del_DSCav1 mut0-mut8) are prepared according to Example 1. In order to assess the effect of single or combined vaccines, these vaccines are administered either alone or in combination as shown in Table 9. Cotton rats receive two intramuscular (i.m.) vaccinations with mRNA-LNP vaccines on days 0 and 28 with 2 µg or 10 µg mRNA for each antigen. Additional groups are immunized intramuscularly (i.m.) with formalin-inactivated RSV and/or live RSV/A2 to compare their immunogenicity to mRNA vaccines. Additional control animals receive buffer only (see Table 15). The RSV-specific immune responses are determined by Elisa or Intracellular cytokine staining (ICS).

TABLE 15

Animal groups of Example 7

| Group | Test Item | SEQ ID NO: RNA | Route |
|---|---|---|---|
| 1 | F | 475, 890, 1259, 1628, 1997, 2366, 2735, 3104, 3473, 3842, 4211, 4580, 4949, 5318, 5687, 6056, 6425, 6794, 7163, 7532, 7901, or 8270 | i.m. |
| 2 | M | 10046 | i.m. |
| 3 | N | 10496 | i.m. |
| 4 | M2-1 | 11545 | i.m. |
| 5 | P | 10999 | i.m. |
| 6 | F + M | F (SEQ ID NOs: 475, 890, 1259, 1628, 1997, 2366, 2735, 3104, 3473, 3842, 4211, 4580, 4949, 5318, 5687, 6056, 6425, 6794, 7163, 7532, 7901, or 8270) + M (SEQ ID NO: 10046) | i.m. |
| 7 | F + N | F (SEQ ID NOs: 475, 890, 1259, 1628, 1997, 2366, 2735, 3104, 3473, 3842, 4211, 4580, 4949, 5318, 5687, 6056, 6425, 6794, 7163, 7532, 7901, or 8270) + N (SEQ ID NO: 10496) | i.m. |
| 8 | F + M2-1 | F (SEQ ID NOs: 475, 890, 1259, 1628, 1997, 2366, 2735, 3104, 3473, 3842, 4211,4580, 4949, 5318, 5687, 6056, 6425, 6794, 7163, 7532, 7901, or 8270) + M2-1 (SEQ ID NO: 11545) | i.m. |
| 9 | F + P | F (SEQ ID NOs: 475, 890, 1259, 1628, 1997, 2366, 2735, 3104, 3473, 3842, 4211, 4580, 4949, 5318, 5687, 6056, 6425, 6794, 7163, 7532, 7901, or 8270) + P (SEQ ID NO: 10999) | i.m. |
| 10 | F + M + P | F (SEQ ID NOs: 475, 890, 1259, 1628, 1997, 2366, 2735, 3104, 3473, 3842, 4211, 4580, 4949, 5318, 5687, 6056, 6425, 6794, 7163, 7532, 7901, or 8270) + P (SEQ ID NO: 10999) + M (SEQ ID NO: 10046). | i.m. |
| 11 | F + M + N + P | F (SEQ ID NOs: 475, 890, 1259, 1628, 1997, 2366, 2735, 3104, 3473, 3842, 4211, 4580, 4949, 5318, 5687, 6056, 6425, 6794, 7163, 7532, 7901, or 8270) + P (SEQ ID NO: 10999) + M (SEQ ID NO: 10046) + N (SEQ ID NO: 10496) | i.m. |
| 12 | Live RSV/A2 virus | | i.n. |
| 13 | UV-Inact. RSV/A2 | | i.m. |
| 14 | FI-RSV | | i.m. |
| 15 | Buffer | | i.m. |
| 16 | Untreated/uninfected | | |

For vaccination experiments of Example 7, polyvalent mRNA compositions/vaccines are produced (e.g. groups 6-10) according to procedures as disclosed in the PCT application WO2017/109134 using at least two different sequence optimized DNA templates (each of which generated as described in Example 1). In short, a DNA construct mixture (each of which comprising a different coding sequences and a T7 promotor) is used as a template for simultaneous RNA in vitro transcription to generate a mixture of mRNA constructs. Subsequently, the obtained RNA mixture is used for co-purification using RP-HPLC. Following that, the obtained purified RNA mixture is formulated in LNPs (as described in section 1.4.) to generate a polyvalent LNP-formulated RNA composition/vaccine.

Determination of Anti-RSV Immune Responses Using ELISA PRNT:

The induction of anti-RSV immune responses are determined as described before, with suitable recombinant proteins or peptides for its detection.

Intracellular Cytokine Staining (ICS):

Splenocytes from vaccinated and control mice are isolated according to a standard protocol. Briefly, isolated spleens are grinded through a cell strainer and washed in PBS/1% FBS followed by red blood cell lysis. After an extensive washing step with PBS/1% FBS splenocytes are seeded into 96-well plates (2×106 cells/well). The next day cells are stimulated with a suitable RSV peptide or an irrelevant control peptide and 2.5 µg/ml of an anti-CD28 antibody (BD Biosciences) for 6 hours at 37° C. in the presence of the mixture of GolgiPlug™/GolgiStop™ (Protein transport inhibitors containing Brefeldin A and Monensin, respectively; BD Biosciences). After stimulation cells are washed and stained for intracellular cytokines using the Cytofix/Cytoperm reagent (BD Biosciences) according to the manufacturer's instructions. The following antibodies are used for staining: CD8-PECy7 (1:200), CD3-FITC (1:200), IL2-PerCP-Cy5.5 (1:100), TNFα-PE (1:100), IFNγ-APC (1:100) (eBioscience), CD4-BD Horizon V450 (1:200) (BD Biosciences) and incubated with Fcγ-block diluted 1:100. Aqua Dye is used to distinguish live/dead cells (Invitrogen). Cells are collected using a Canto II flow cytometer (Beckton Dickinson). Flow cytometry data are analysed using FlowJo software (Tree Star, Inc.).

Cotton Rat Challenge Study:

The vaccinated animals are challenged intranasally at day 63 with 10exp5 pfu live RSV/A2 virus in 10 uL. One control group remains untreated and uninfected. All animals are sacrificed at day 68 and nasal tissue and lung tissue are harvested.

Cotton Rat Challenge Study:

The vaccinated animals are challenged intranasally at day 63 with 10exp5 pfu live RSV/A2 virus in 10 uL. One control group remains untreated and uninfected. All animals are sacrificed at day 68 and nasal tissue and lung tissue are harvested. Serum is collected at day 49 and RSV virus neutralization titers (VNTs) are measured using a plaque reduction neutralization test (PRNT) as described in Example 2.

RSV Titers in the Lungs of Challenged Cotton Rats:

Lungs of animals are collected at day 68 (i.e. 5 days after intranasal challenge with 10exp5 pfu live RSV/A2 virus) and RSV/A2 titers are quantified in one lobe by plaque assay as described above. In addition, RSV viral genome copy numbers (by measuring copy numbers of the RSV NS-1 gene) and cytokine mRNA levels were determined by quantitative reverse transcription polymerase chain reaction (qRT-PCR).

RSV Titers in Nasal Tissue of Challenged Cotton Rats:

Nasal tissue of animals are collected at day 68 (i.e. 5 days after intranasal challenge with 105 pfu live RSV/A2 virus). The viral titers are quantified as described above. In addition, RSV viral genome copy numbers (by measuring copy numbers of the RSV NS-1 gene) and cytokine mRNA levels were determined by quantitative reverse transcription polymerase chain reaction (qRT-PCR).

Lung Histopatholoqy of Challenged Cotton Rats:

Lungs of animals are collected at day 68 (i.e. 5 days after intranasal challenge with 105 pfu live RSV/A2 virus) and one lobe is analyzed by histopathology as described before.

Figure 10A:
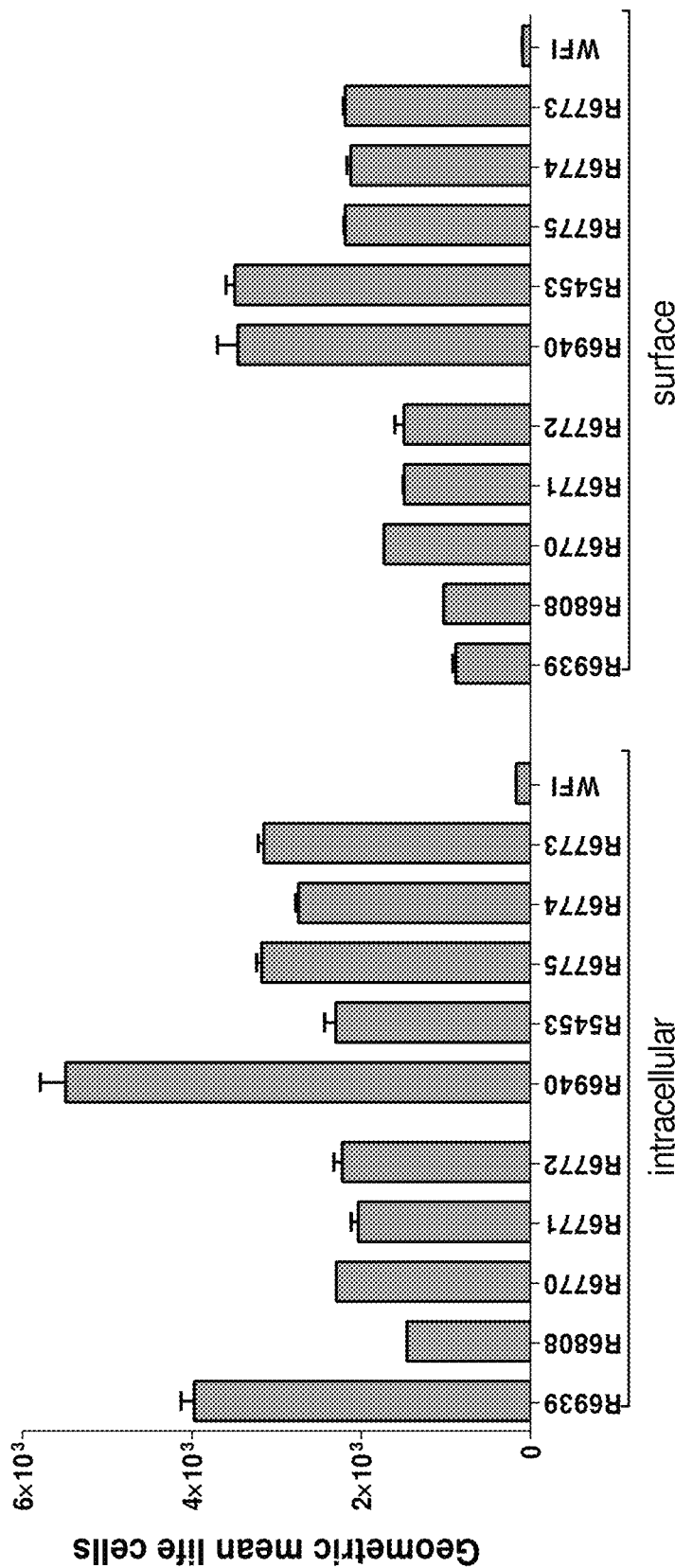
FIGS. 10A-B show that the used mRNA constructs encoding RSV F-protein (FIG. 10A: F0, F-del, F0_DSCav1, F-del_DSCav1, F_DSCav1_mut1, F-del_DSCav1_mut1, F_DSCav1_mut2, F-del_DSCav1_mut2, F_DSCav1_mut3, F-del_DSCav1_mut3, FIG. 10B: F0, F-del, F0_DSCav1, F-del_DSCav1, F_DSCav1_mut0, F-del_DSCav1_mut0, F_DSCav1_mut4, F-del_DSCav1_mut4, F_DSCav1_mut5, F-del_DSCav1_mut5) led to a detectable intracellular RSV F protein expression as well as to a detectable protein expression at the cell surface. Further details are provided in Table 16 and Example 8.
Figure 10B:
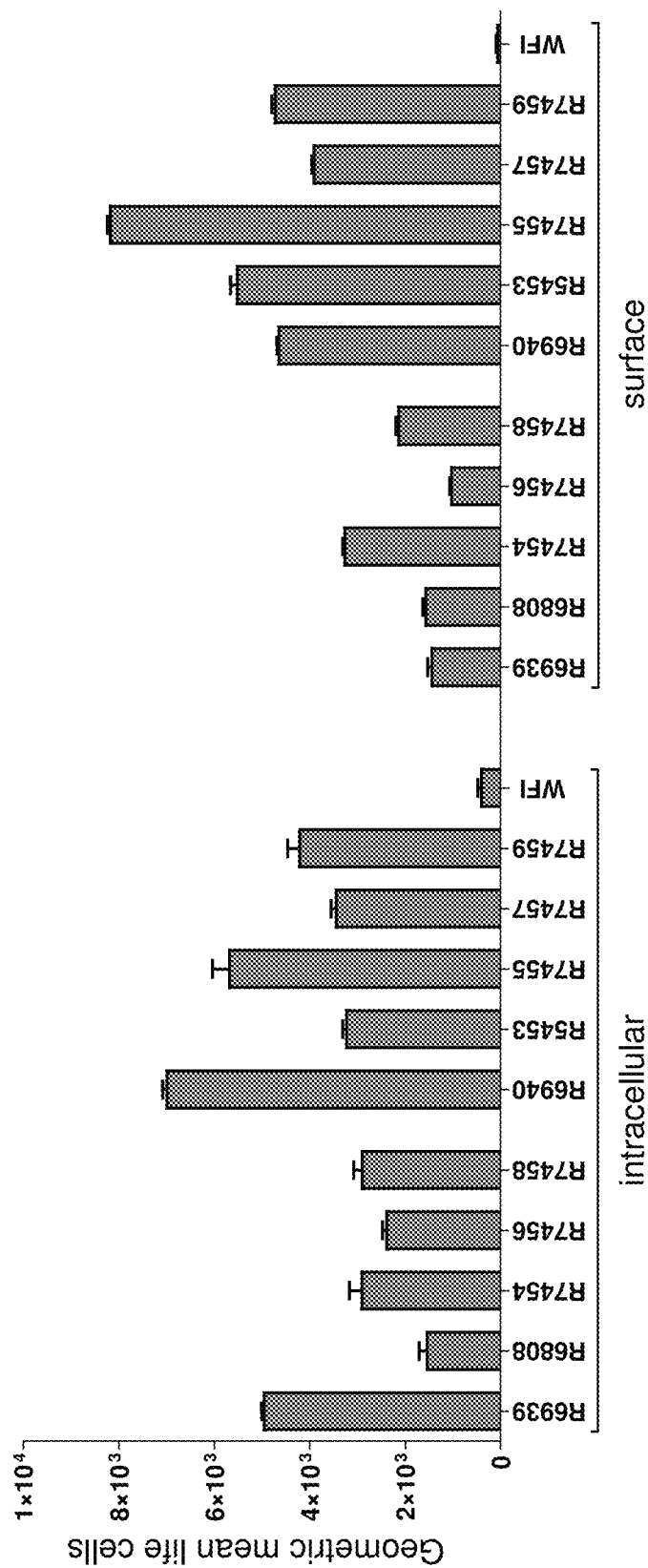

Example 8: Expression of Different RSV F Proteins in HeLa Cells and Analysis by FACS To determine in vitro protein expression of the mRNA constructs, HeLa cells were transiently transfected with mRNA encoding RSV F antigens and stained for RSV Fusing a suitable anti-F protein antibodies (raised in mouse), counterstained with a FITC-coupled secondary anti-mouse antibody (F5262 from Sigma). HeLa cells were seeded in a 6-well plate at a density of 400,000 cells/well in cell culture medium (RPMI, 10% FCS, 1% L-Glutamine, 1% Pen/Strep), 24 h prior to transfection. HeLa cells were transfected with 2 µg unformulated mRNA using Lipofectamine 2000 (Invitrogen). The mRNA constructs prepared according to Example 1 and listed in Table 16 were used in the experiment (see also Table 9), including a negative control (water for injection). 24 hours post transfection, HeLa cells were stained with suitable anti RSV-F antibodies (raised in mouse; 1:500) and anti-mouse FITC labelled secondary antibody (1:500) and subsequently analyzed by flow cytometry (FACS) on a BD FACS Canto II using the FACS Diva software. Quantitative analysis of the fluorescent FITC signal was performed using the FlowJo software package (Tree Star, Inc.). Cells were stained intracellularly or alternatively on the cell surface. The results are shown in FIGS. 10A and 10B, representing two different independent experiments.

TABLE 16

Overview of mRNA constructs used in Example 8

| RNA ID | Antigen | UTR Design | SEQ ID NO: RNA | SEQ ID NO: Protein | see Figure |
|---|---|---|---|---|---|
| R6939 | F0 | —/muag; i-3 | 475 | 68 | 10a, 10b |
| R6808 | F0_DSCav1 | —/muag; i-3 | 1259 | 898 | 10a, 10b |
| R6770 | F_DSCav1_mut3 | —/muag; i-3 | 3473 | 3112 | 10a |
| R6771 | F_DSCav1_mut1 | —/muag; i-3 | 1997 | 1636 | 10a |
| R6772 | F_DSCav1_mut2 | —/muag; i-3 | 2735 | 2374 | 10a |
| R6940 | F-del | —/muag; i-3 | 890 | 483 | 10a, 10b |
| R5453 | F-del_DSCav1 | —/muag; i-3 | 1628 | 1267 | 10a, 10b |

TABLE 16-continued

Overview of mRNA constructs used in Example 8

| RNA ID | Antigen | UTR Design | SEQ ID NO: RNA | SEQ ID NO: Protein | see Figure |
|---|---|---|---|---|---|
| R6775 | F-del_DSCav1_mut3 | —/muag; i-3 | 3842 | 3481 | 10a |
| R6774 | F-del_DSCav1_mut1 | —/muag; i-3 | 2366 | 2005 | 10a |
| R6773 | F-del_DSCav1_mut2 | —/muag; i-3 | 3104 | 2743 | 10a |
| R7454 | F_DSCav1_mut0 | —/muag; i-3 | 4211 | 3850 | 10b |
| R7456 | F_DSCav1_mut5 | —/muag; i-3 | 5687 | 5326 | 10b |
| R7458 | F_DSCav1_mut4 | —/muag; i-3 | 4949 | 4588 | 10b |
| R7455 | F-del_DSCav1_mut0 | —/muag; i-3 | 4580 | 4219 | 10b |
| R7457 | F-del_DSCav1_mut5 | —/muag; i-3 | 6056 | 5695 | 10b |
| R7459 | F-del_DSCav1_mut4 | —/muag; i-3 | 5318 | 4957 | 10b |

Results:

The results show that the used mRNA constructs led to a detectable intracellular RSV F protein expression as well as to a detectable protein expression at the cell surface. The RSV F constructs with deleted C-terminus (F-del) (e.g. R6940, R5453, R6775, R6774, R6773, R7455, R7457, R7459) show an increased cell surface protein expression in comparison to F full length constructs. The construct encoding F-del_DSCav1_mut0 (R7455) exhibits the highest expression.

The results exemplify that the inventive mRNA encoding F proteins (F0, F-del, F0_DSCav1, F-del_DSCav1, F_DSCav1_mut0, F-del_DSCav1_mut0, F_DSCav1_mut1, F-del_DSCav1_mut1, F_DSCav1_mut2, F-del_DSCav1_mut2, F_DSCav1_mut3, F-del_DSCav1_mut3, F_DSCav1_mut4, F-del_DSCav1_mut4, F_DSCav1_mut5, F-del_DSCav1_mut5) is translated in cells and are present at the cell surface, which is a prerequisite for an mRNA-based RSV vaccine.

Example 9: Vaccination of Cotton Rats with LNP-Formulated mRNA Encoding RSV-F and RSV Cotton Rat Challenge Study The present Example shows that LNP-formulated mRNA according to the invention encoding different pre-fusion stabilized RSV-F antigens induce strong, functional and protective immune responses in cotton rats.

This experiment compared mRNA-LNPs encoding different pre-fusion stabilized RSV-F variants (mut 1, mut2, mut3) with either full-length F or with the truncated F (F-del). The mRNA-LNP vaccines were prepared according to Example 1. Cotton rats received two intramuscular vaccinations with mRNA-LNP vaccines on days 0 and 28. Each dose comprised 100 µg mRNA-LNPs. Control animals received a single vaccination at day 0 with $10^5$ pfu live RSV/A2 virus or UV inactivated RSV/A2 virus or two vaccinations at days 0 and 28 with formalin-inactivated RSV virus (FI RSV) intramuscularly. Additional control animals received buffer only (see Table 17).

TABLE 17

Animal groups and vaccination schedule of Example 9

| Group | Test item | RNA ID | SEQ ID NO: RNA | SEQ ID NO: Protein | Dose | Route |
|---|---|---|---|---|---|---|
| 1 | mRNA encoding F0 LNP-formulated | R6939 | 475 | 68 | 100 µg | i.m. |
| 2 | mRNA encoding F0_DSCav1 LNP-formulated | R6808 | 1259 | 898 | 100 µg | i.m. |
| 3 | mRNA encoding F_DSCav1_mut3 LNP-formulated | R6770 | 3473 | 3112 | 100 µg | i.m. |
| 4 | mRNA encoding F_DSCav1_mut1 LNP-formulated | R6771 | 1997 | 1636 | 100 µg | i.m. |
| 5 | mRNA encoding F_DSCav1_mut2 LNP-formulated | R6772 | 2735 | 2374 | 100 µg | i.m. |
| 6 | mRNA encoding F-del LNP-formulated | R6940 | 890 | 483 | 100 µg | i.m. |
| 7 | mRNA encoding F-del_DSCav1 LNP-formulated | R5453 | 1628 | 1267 | 100 µg | i.m. |
| 8 | mRNA encoding F-del_DSCav1_mut3 LNP-formulated | R6775 | 3842 | 3481 | 100 µg | i.m. |
| 9 | mRNA encoding F-del_DSCav1_mut1 LNP-formulated | R6774 | 2366 | 2005 | 100 µg | i.m. |
| 10 | mRNA encoding F-del_DSCav1_mut2 LNP-formulated | R6773 | 3104 | 2743 | 100 µg | i.m. |
| 11 | Live RSV/A2 virus | | | | $10^5$ | i.m. |
| 12 | UV-inact. RSV/A2 | | | | $10^5$ | i.m. |

TABLE 17-continued

Animal groups and vaccination schedule of Example 9

| Group | Test item | RNA ID | SEQ ID NO: RNA | SEQ ID NO: Protein | Dose | Route |
|---|---|---|---|---|---|---|
| 13 | FI RSV | | | | 1:100 | i.m. |
| 14 | Buffer | | | | | i.m. |
| 15 | untreated/uninfected | | | | | i.m. |

Determination of Anti-RSV F Protein Antibodies by ELISA:

Blood samples were collected on days 0, 28, 49, and 63 for the determination of anti-RSV F antibody titers. ELISA plates were coated with purified F protein extracted from RSV/A2-infected HEp-2 cells or methanol/Acetone fixed RSV/B infected HEp-2 cells. Coated plates were incubated using given serum dilutions. Binding of specific antibodies to the F protein was detected using isotype specific anti-cotton rat antibodies in combination with streptavidin-HRP (horse radish peroxidase) with TMB substrate.

Determination of Virus Neutralization Titers:

Serum was collected on days 0, 28, 49, and 63 and RSV virus neutralization titers (VNTs) were measured using a plaque reduction neutralization test (PRNT). Diluted serum samples were incubated with RSV/A2 or RSV/B (25-50 PFU) for 1 hour at room temperature and inoculated in duplicates onto confluent HEp-2 monolayers in 24 well plates. After one hour incubation at 3700 in a 5% 002 incubator, the wells were overlayed with 0.75% Methylcellulose medium. After 4 days of incubation, the overlays were removed and the cells were fixed and stained. The corresponding reciprocal neutralizing antibody titers were determined at the 60% reduction end-point of the virus control.

Cotton Rat Challenge Study:

The vaccinated animals were challenged intranasally at day 63 with $10^5$ pfu live RSV/A2 virus in 100 uL. One control group remained untreated and uninfected. All animals were sacrificed at day 68 and nasal tissue and lung were harvested.

RSV Titers in Nasal Tissue of Challenged Cotton Rats

Lungs and nasal tissue of animals were collected at day 68 (i.e. 5 days after intranasal challenge with $10^5$ pfu live RSV/A2 virus). The nose homogenates were clarified as the lung homogenates by centrifugation and diluted in EMEM. Confluent HEp-2 monolayers were infected in duplicates with diluted homogenates in 24 well plates. After one hour incubation at 37° C. in a 5% CO incubator, the wells were overlayed with 0.75% methylcellulose medium. After 4 days of incubation, the overlays were removed and the cells were fixed and stained with 0.1% crystal violet for one hour and then rinsed and air dried. Plaques were counted and virus titers were expressed as plaque forming units per gram of tissue.

Pulmonary Histopathology

Lungs were dissected and inflated with 10% neutral buffered formalin to their normal volume, and then immersed in the same fixative solution. Following fixation, the lungs were embedded in paraffin, sectioned and stained with hematoxylin and eosin (H&E). Four parameters of pulmonary inflammation were evaluated: peribronchiolitis (inflammatory cell infiltration around the bronchioles), perivasculitis (inflammatory cell infiltration around the small blood vessels), interstitial pneumonia (inflammatory cell infiltration and thickening of alveolar walls), and alveolitis (cells within the alveolar spaces). Slides are scored blind on a 0-4 severity scale. The scores are subsequently converted to a 0-100% histopathology scale.

Figure 11:
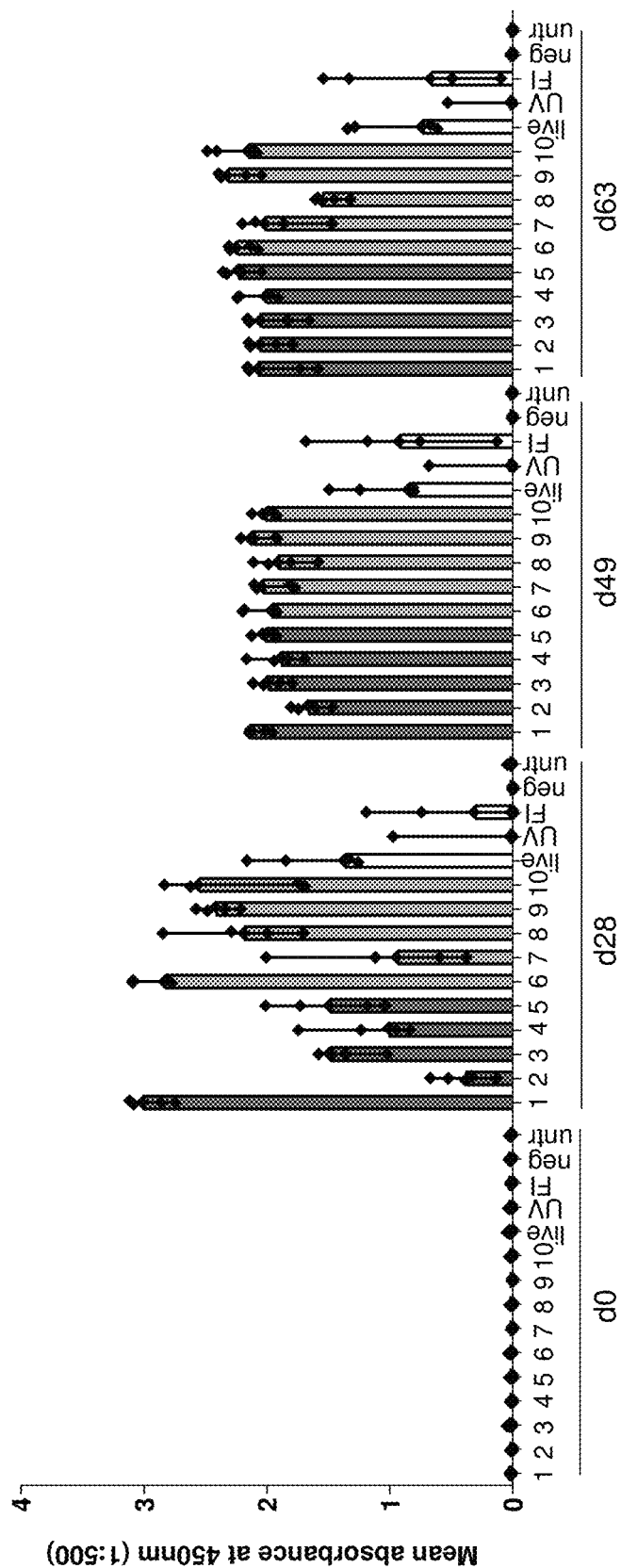
FIG. 11 shows that all tested LNP-formulated mRNA constructs encoding different RSV F proteins (F0, F0_DSCav1, F_DSCav1_mut3, F_DSCav1_mut1, F_DSCav1_mut2, F-del, F-del_DSCav1, F-del_DSCav1_mut3, F-del_DSCav1_mut1, F-del_DSCav1_mut2) induce humoral immune responses in cotton rats against the RSV-F protein. Antibody total IgG titers were determined by ELISA. Vaccination schedule see Table 17. Further details are provided in Example 9.
Figure 12:
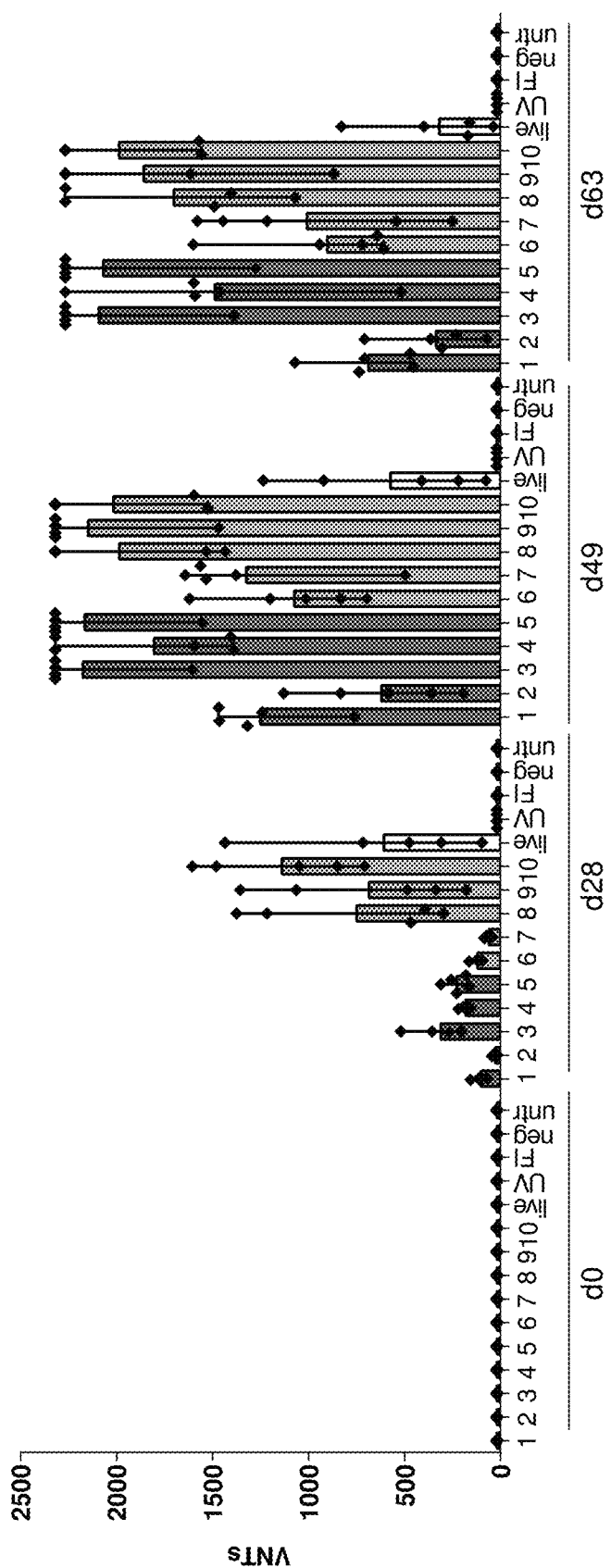
FIG. 12 shows that all LNP-formulated RSV-F (F0, F0_DSCav1, F_DSCav1_mut3, F_DSCav1_mut1, F_DSCav1_mut2, F-del, F-del_DSCav1, F-del_DSCav1_mut3, F-del_DSCav1_mut1, F-del_DSCav1_mut2) mRNA vaccines induced the formation of RSV specific functional antibodies in cotton rats as shown by high virus neutralizing antibody titers. Vaccination schedule see Table 17. Further details are provided in Example 9.
Figure 13:
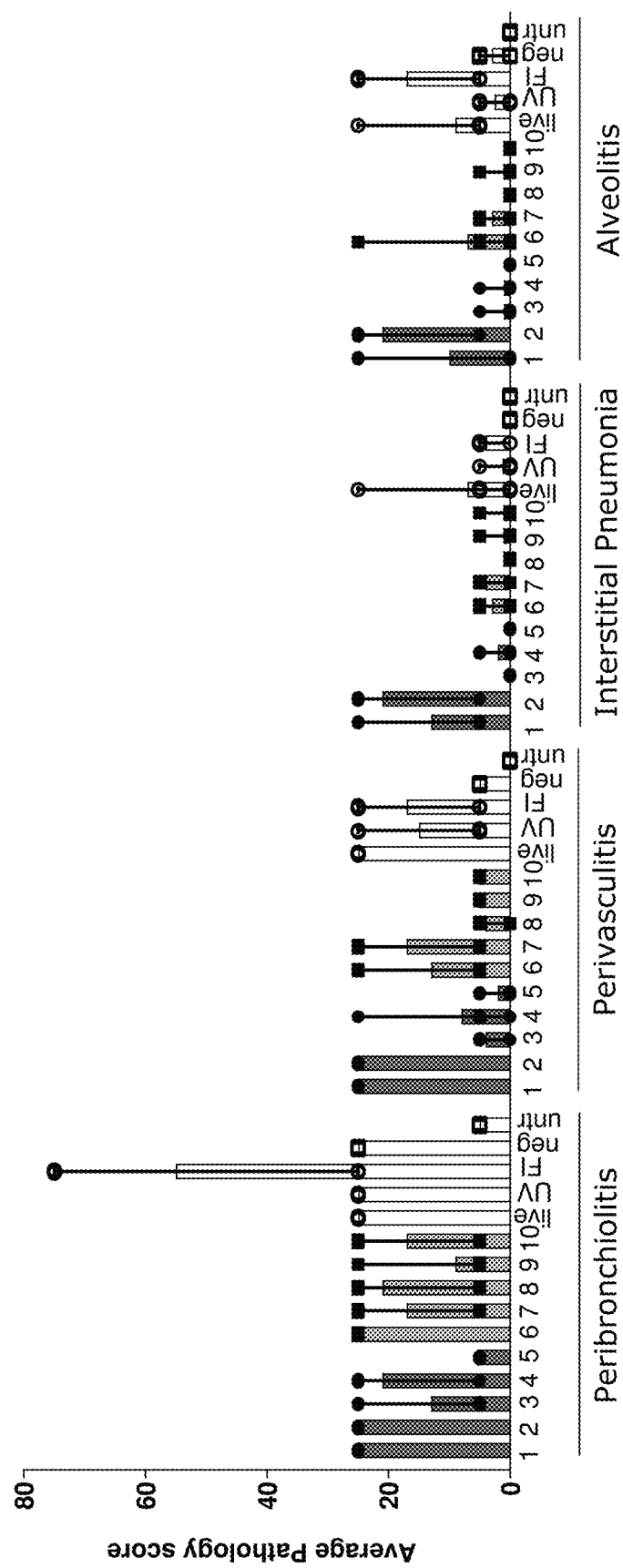
FIG. 13 shows the lung histopathology analysis from the RSV cotton rat challenge study. None of the mRNA vaccinated groups displayed enhanced lung pathology as it is the case for the group that was vaccinated using the formalin-inactivated RSV vaccine Vaccination schedule see Table 17. Further details are provided in Example 9.

Results:

FIG. 11 shows that all tested LNP-formulated mRNA constructs encoding different RSV F proteins (F0, F0_DSCav1, F_DSCav1_mut3, F_DSCav1_mut1, F_DSCav1_mut2, F-del, F-del_DSCav1, F-del_DSCav1_mut3, F-del_DSCav1_mut1, F-del_DSCav1_mut2) according the invention induce humoral immune responses in cotton rats against the RSV-F protein. Antibody total IgG titers were determined by ELISA.

The mRNA constructs encoding the truncated F (F-del) (F-del, F-del_DSCav1, F-del_DSCav1_mut3, F-del_DSCav1_mut1, F-del_DSCav1_mut2) induced higher and faster responses than the constructs with the full length F sequence on d28, no significant difference is detectable at later time points. Stabilized constructs (F0_DSCav1, F_DSCav1_mut3, F_DSCav1_mut1, F_DSCav1_mut2, F-del_DSCav1, F-del_DSCav1_mut3, F-del_DSCav1_mut1, F-del_DSCav1_mut2) initially yield lower ELISA titers than wildtype constructs (F0 and F-del). Levels are not significantly different at later time points.

With a dose of 100 μg, the constructs encoding the stabilized and truncated F protein (F-del_DSCav1_mut3, F-del_DSCav1_mut1, F-del_DSCav1_mut2) induce higher titers of RSV-F specific IgGs already after prime vaccination (day 28) compared with the vaccination with the live virus. After boost vaccination all tested LNP-formulated RSV-F mRNA vaccines induces humoral immune responses measured with ELISA which are more prominent then the answers of the control vaccinations.

As can be seen from FIG. 12, all LNP-formulated RSV-F (F0, F0_DSCav1, F_DSCav1_mut3, F_DSCav1_mut1, F_DSCav1_mut2, F-del, F-del_DSCav1, F-del_DSCav1_mut3, F-del_DSCav1_mut1, F-del_DSCav1_mut2) mRNA vaccines induced the formation of RSV specific functional antibodies in cotton rats as shown by high virus neutralizing antibody titers. The LNP-formulated RSV-F truncated constructs (F-del, F-del_DSCav1, F-del_DSCav1_mut3, F-del_DSCav1_mut1, F-del_DSCav1_mut2) induced higher and faster responses than F full length constructs. The constructs for pre-fusion stabilization according to the invention (F_DSCav1_mut3, F_DSCav1_mut1, F_DSCav1_mut2, F-del_DSCav1_mut3, F-del_DSCav1_mut1, F-del_DSCav1_mut2) induce higher responses than F0, F0_DSCav1, F-del, F-del_DSCav1.

As can be seen from FIG. 13, the lung histopathology analysis from the RSV cotton rat challenge study reveals different pathology scores for the various animal groups. From the histopathology it can be concluded that none of the mRNA vaccinated groups displayed enhanced lung pathology as it is the case for the group that was vaccinated using the formalin-inactivated RSV vaccine. The average pathology scores for peribronchiolitis are lower for all groups vaccinated with mRNA compared to the group with formalin-inactivated RSV. The LNP-formulated RSV-F truncated constructs (F-del, F-del_DSCav1, F-del_DSCav1_mut3, F-del_DSCav1_mut1, F-del_DSCav1_mut2) showed in general lower pathology scores than F full length constructs. The constructs for pre-fusion stabilization according to the invention (F_DSCav1_mut3, F_DSCav1_mut1, F_DSCav1_mut2, F-del_DSCav1_mut3, F-del_DSCav1_mut1, F-del_DSCav1_mut2) yielded better responses (lower pathology scores) than F0, F0_DSCav1, F-del, F-del_DSCav1.

Figure 14A:
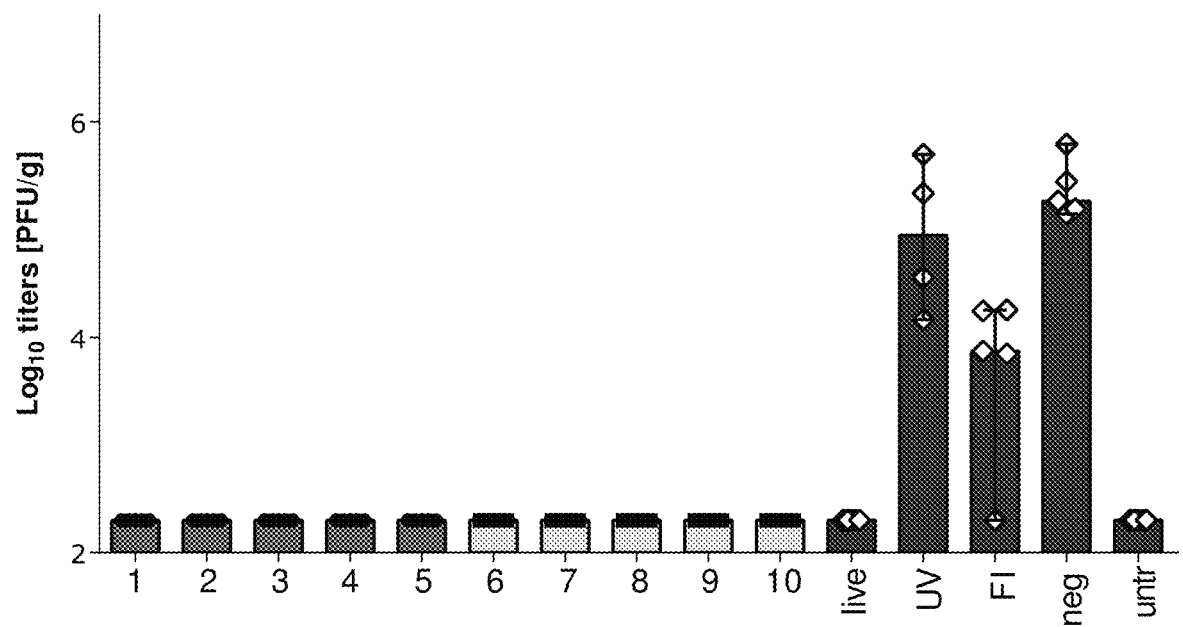
FIGS. 14A-B show the results of the analysis of lung viral titers (FIG. 14A) and of nose viral titers (FIG. 14B) in cotton rats challenged with RSV virus. Vaccination schedule see Table 17. Further details are provided in Example 9.

As can be seen from FIG. 14A, all in this experiment tested LNP-formulated RSV-F mRNA vaccines reduced lung viral titers in cotton rats challenged with RSV virus and therefore limit RSV infection of the lung. All the animal groups vaccinated with mRNA formulated in LNPs vaccines showed virus titers below the level of detection of the performed virus titration. The results demonstrate protection of vaccinated cotton rats in terms of viral lung titers. By contrast, the formalin-inactivated virus vaccine (FI RSV) and the UV-inactivated RSV/A2 virus control reduced only minimally the lung virus titer compared to the buffer control group.

Figure 14B:
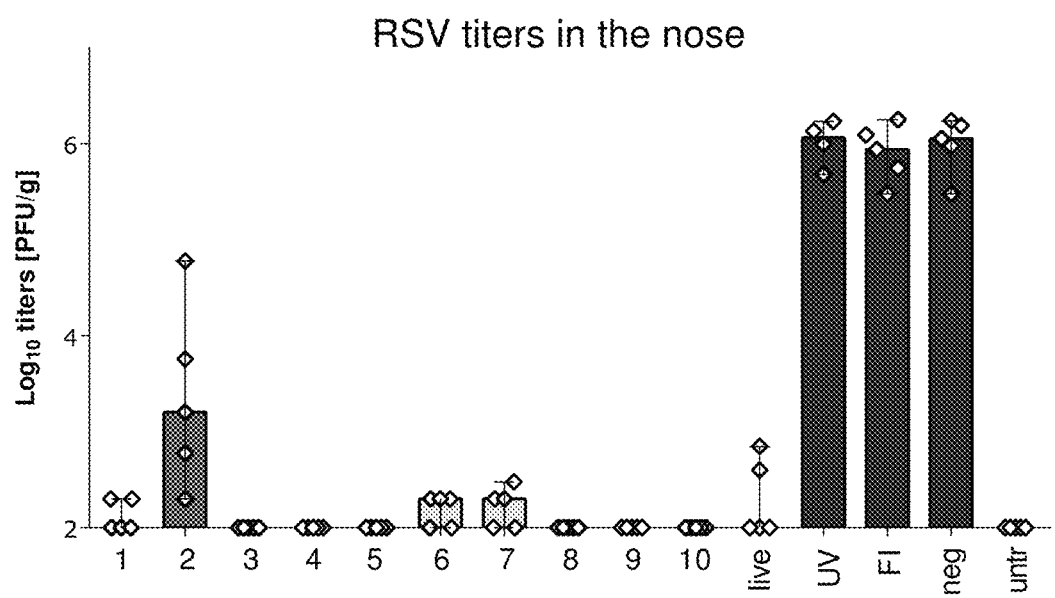

As can be seen from FIG. 14B, the LNP-formulated RSV-F mRNA vaccines strongly reduced viral titers in nasal tissue of cotton rats challenged with RSV virus and therefore reduce RSV infection of the nose. In comparison to the mRNA vaccines the vaccine based on formalin-inactivated virus (FI RSV) and the UV-inactivated RSV/A2 virus control were not able to reduce the nasal virus titers. A complete protection of the nose was only achieved by the pre-fusion stabilization according to the invention (F_DSCav1_mut3, F_DSCav1_mut1, F_DSCav1_mut2, F-del_DSCav1_mut3, F-del_DSCav1_mut1, F-del_DSCav1_mut2).

To conclude, the results show that LNP-formulated RNA constructs encoding RSV-F truncated proteins (F-del, F-del_DSCav1, F-del_DSCav1_mut3, F-del_DSCav1_mut1, F-del_DSCav1_mut2) are in general more immunogenic than RNA constructs encoding for full length F proteins. Constructs featuring Ds-Cav1 mutations alone (F0_DSCav1 and F-del_DSCav1) are suboptimal as an mRNA based vaccine in comparison with the constructs encoding the further stabilized F proteins according the invention (F_DSCav1_mut3, F_DSCav1_mut1, F_DSCav1_mut2, F-del_DSCav1_mut3, F-del_DSCav1_mut1, F-del_DSCav1_mut2).

To further improve the efficiency of the mRNA-based vaccine, several alternative RSV-F mRNA constructs were designed harboring further mutations stabilizing the pre-fusion conformation in combination with the beneficial truncated F-del protein. Those mRNA constructs were tested as can be seen in the following Example.

Example 10: Vaccination of Cotton Rats with LNP-Formulated mRNA Encoding RSV-F and RSV Cotton Rat Challenge Study The present Example shows that LNP-formulated mRNA according to the invention encoding different pre-fusion stabilized RSV-F antigens induce strong, functional and protective immune responses in cotton rats.

The mRNA-LNP vaccines were prepared according to Example 1. Cotton rats received either one or two intramuscular vaccinations with mRNA-LNP vaccines on day 0 or on days 0 and 28. Each dose comprised 1 μg mRNA-LNPs. Control animals received a single vaccination at day 28 with 100 pfu live RSV/A2 virus or formalin-inactivated RSV virus (FI RSV) intramuscularly. Additional control animals received buffer only (see Table 18).

TABLE 18

| Animal groups and vaccination schedule of Example 10 | | | | | | | |
|---|---|---|---|---|---|---|---|
| Group | Test item | RNA ID | SEQ ID NO: RNA | SEQ ID NO: Protein | Dose | Immunization | Route |
| 1 | (1) mRNA encoding F-del LNP-formulated | R6940 | 890 | 483 | 100 μg | day 0, day 28 | i.m. |
| 2 | (2) mRNA encoding F-del_DSCav1_mut2 LNP-formulated | R6773 | 3104 | 2743 | 100 μg | day 0, day 28 | i.m. |
| 3 | (3) mRNA encoding F-del_DSCav1_mut0 LNP-formulated | R7455 | 4580 | 4219 | 100 μg | day 0, day 28 | i.m. |
| 4 | (4) mRNA encoding F-del_DSCav1_mut5 LNP-formulated | R7457 | 6056 | 5695 | 100 μg | day 0, day 28 | i.m. |
| 5 | (5) mRNA encoding F-del_DSCav1_mut4 LNP-formulated | R7459 | 5318 | 4957 | 100 μg | day 0, day 28 | i.m. |
| 6 | (1) mRNA encoding F-del LNP-formulated | R6940 | 890 | 483 | 100 μg | day 28 | i.m. |
| 7 | (2) mRNA encoding F-del_DSCav1_mut2 LNP-formulated | R6773 | 3104 | 2743 | 100 μg | day 28 | i.m. |
| 8 | (3) mRNA encoding F-del_DSCav1_mut0 LNP-formulated | R7455 | 4580 | 4219 | 100 μg | day 28 | i.m. |
| 9 | (4) mRNA encoding F-del_DSCav1_mut5 LNP-formulated | R7457 | 6056 | 5695 | 100 μg | day 28 | i.m. |

TABLE 18-continued

Animal groups and vaccination schedule of Example 10

| Group | Test item | RNA ID | SEQ ID NO: RNA | SEQ ID NO: Protein | Dose | Immunization | Route |
|---|---|---|---|---|---|---|---|
| 10 | (5) mRNA encoding F-del_DSCav1_mut4 LNP-formulated | R7459 | 5318 | 4957 | 100 μg | day 28 | i.m. |
| 11 | Live RSV/A2 virus | | | | $10^5$ | day 28 | i.m. |
| 12 | FI RSV | | | | 1:100 | day 28 | i.m. |
| 13 | Buffer | | | | | day 0, day 28 | i.m. |
| 14 | untreated/uninfected | | | | | | i.m. |

Determination of Anti-RSV F Protein Antibodies by ELISA and Virus Neutralization Titers Blood samples were collected on days 0, 28, 49, and 63 for the determination of anti-RSV F antibody titers and RSV virus neutralization titers (VNTs) measured using the plaque reduction neutralization test (PRNT) as described before (see Example 9).

Cotton Rat Challenge Study:

The vaccinated animals were challenged intranasally at day 63 with $10^5$ pfu live RSV/A2 virus in 100 uL. One control group remained untreated and uninfected. All animals were sacrificed at day 68 and nasal tissue and lung were harvested. The RSV titers in nasal tissue of challenged cotton rats and the pulmonary histopathology are analyzed as described before (see Example 9).

Figure 15:
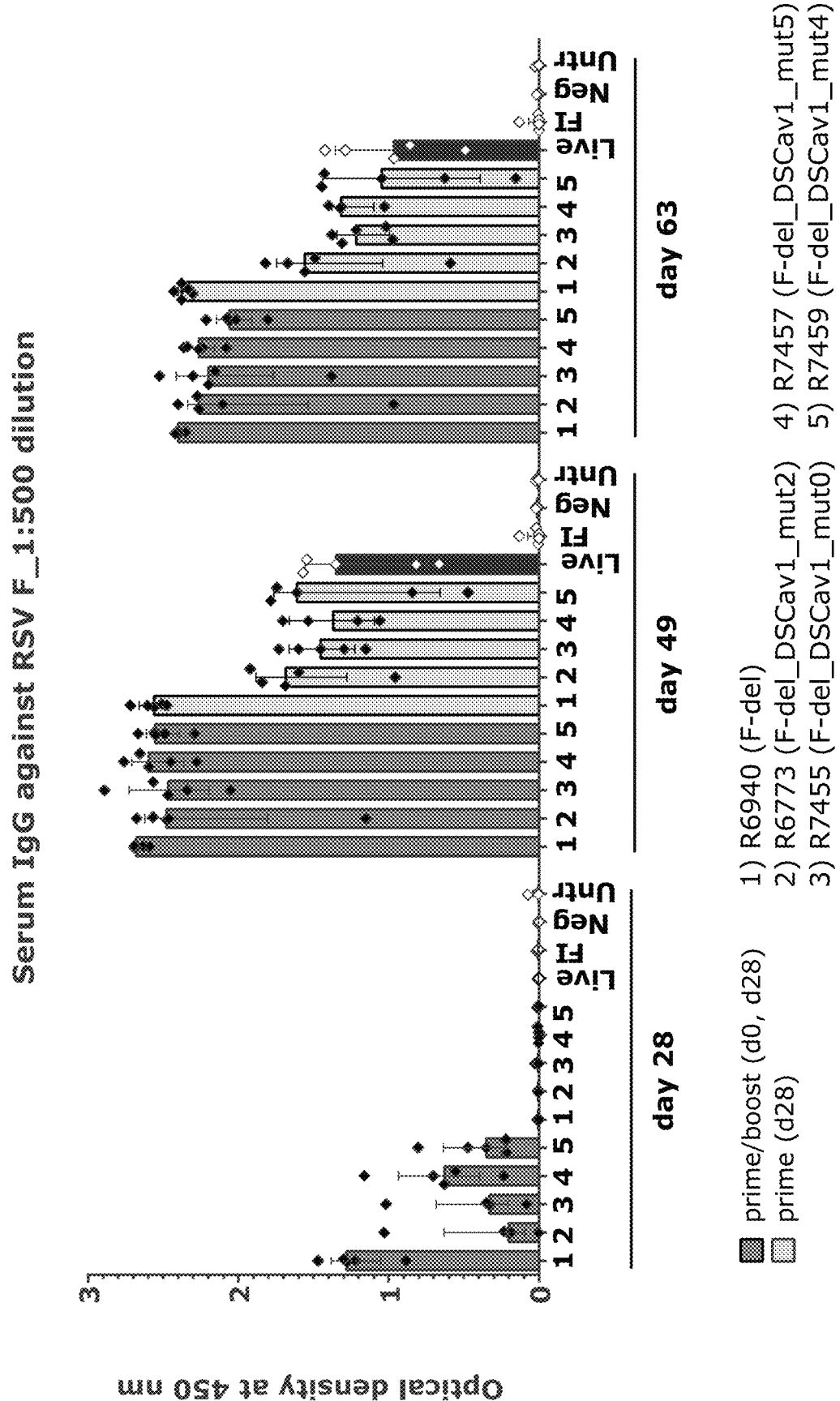
FIG. 15 shows that all tested LNP-formulated mRNA constructs encoding different RSV F proteins (F-del, F-del_DSCav1_mut2, F-del_DSCav1_mut0, F-del_DSCav1_mut5, F-del_DSCav1_mut4) induce humoral immune responses in cotton rats against the RSV-F protein. Antibody total IgG titers were determined by ELISA. Vaccination schedule see Table 18. Further details are provided in Example 10.

Results:

FIG. 15 shows that all tested LNP-formulated mRNA constructs encoding different RSV F proteins (F-del, F-del_DSCav1_mut2, F-del_DSCav1_mut0, F-del_DSCav1_mut5, F-del_DSCav1_mut4) according the invention induce humoral immune responses in cotton rats against the RSV-F protein. Antibody total IgG titers were determined by ELISA. RNA constructs encoding stabilized F proteins (F-del_DSCav1_mut2, F-del_DSCav1_mut0, F-del_DSCav1_mut5, F-del_DSCav1_mut4) initially yield lower ELISA titers than the construct encoding the truncated wildtype F protein, F-del. This trend is also detectable at later time points by using higher serum dilutions for the ELISA (data not shown). The IgG response can be significantly boosted by a second immunization.

Figure 16:
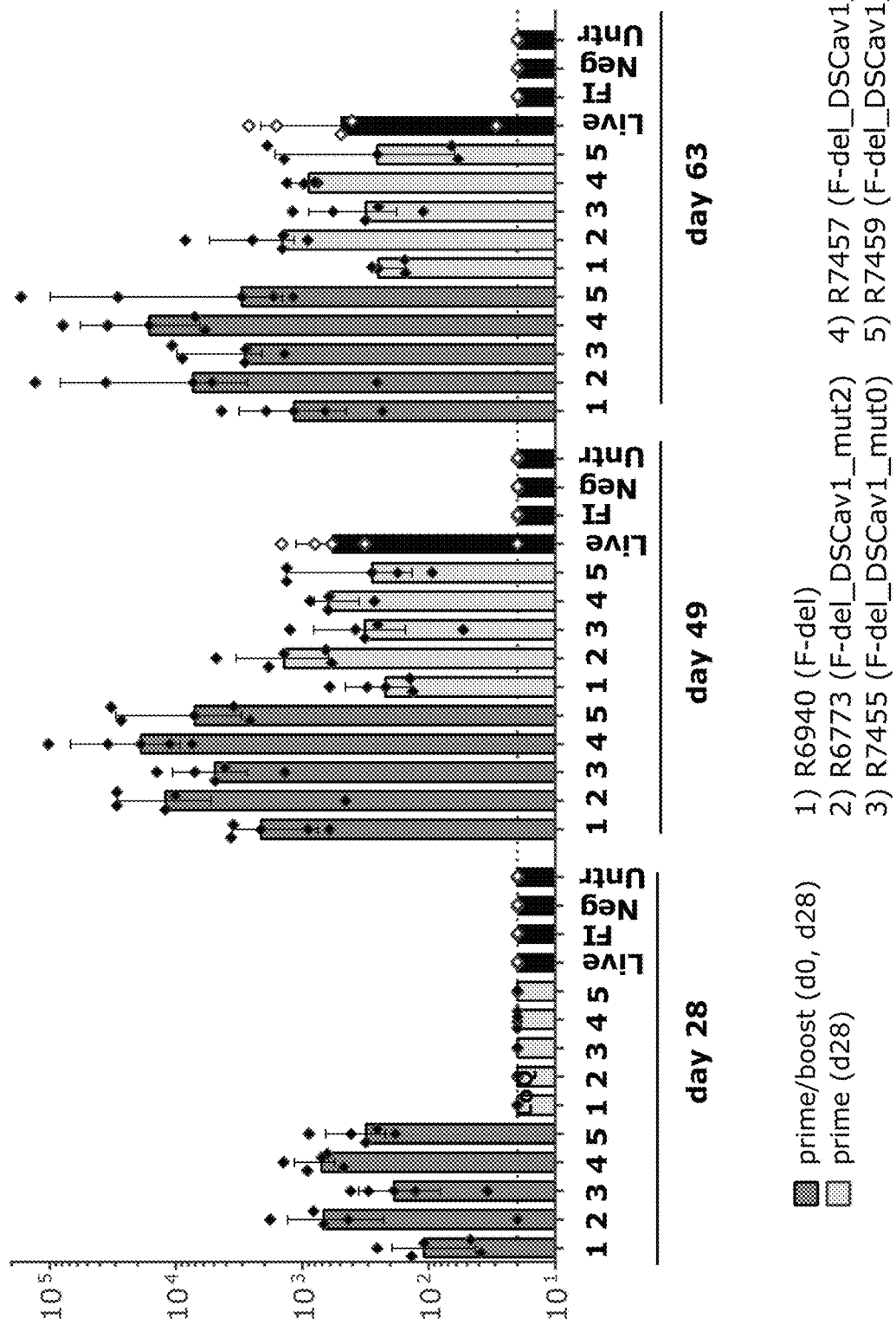
FIG. 16 shows that all LNP-formulated RSV-F (F-del, F-del_DSCav1_mut2, F-del_DSCav1_mut0, F-del_DSCav1_mut5, F-del_DSCav1_mut4) mRNA vaccines induced the formation of RSV specific functional antibodies in cotton rats as shown by high virus neutralizing antibody titers. The LNP-formulated constructs for pre-fusion stabilization induce higher or comparable responses than F-del. Vaccination schedule see Table 18. Further details are provided in Example 10.

As can be seen from FIG. 16, all LNP-formulated RSV-F (F-del, F-del_DSCav1_mut2, F-del_DSCav1_mut0, F-del_DSCav1_mut5, F-del_DSCav1_mut4) mRNA vaccines induced the formation of RSV specific functional antibodies in cotton rats as shown by high virus neutralizing antibody titers. The LNP-formulated constructs for pre-fusion stabilization according to the invention (F-del_DSCav1_mut2, F-del_DSCav1_mut0, F-del_DSCav1_mut5, F-del_DSCav1_mut4) induce higher or comparable responses than F-del. The RNA construct R7457 coding for the pre-fusion stabilized protein F-del_DSCav1_mut5 induces the highest VNTs (comparable to the best results induced by best pre-fusion stabilized construct in the previous experiment (Example 9, R6773).

Figure 17A:
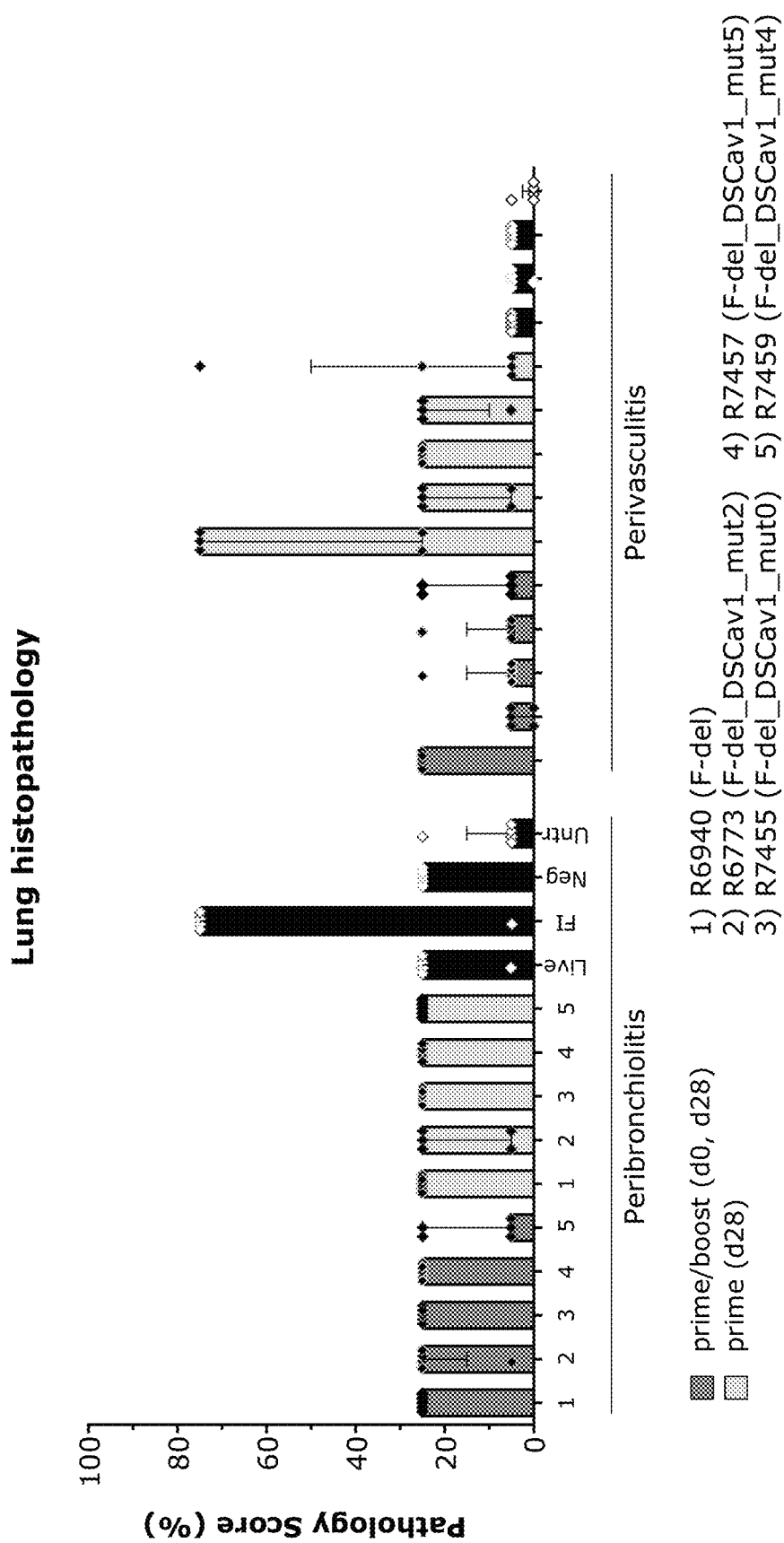
FIGS. 17A-B show the lung histopathology analysis from the RSV cotton rat challenge study. None of the mRNA vaccinated groups displayed enhanced lung pathology as it is the case for the group that was vaccinated using the formalin-inactivated RSV vaccine Vaccination schedule see Table 18. Further details are provided in Example 10.
Figure 17B:
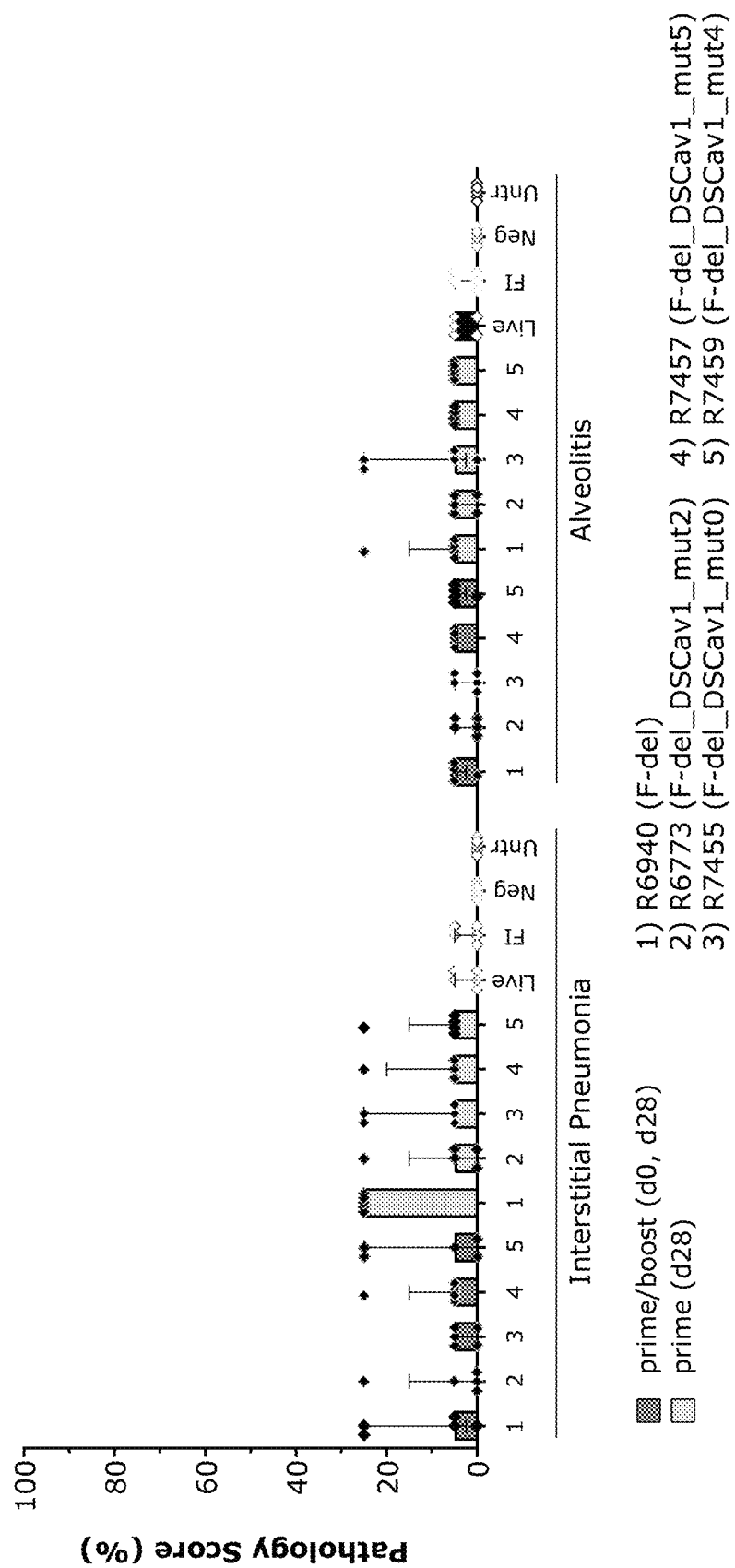

The lung histopathology analysis shows that none of the mRNA vaccinated groups displayed enhanced lung pathology as it is the case for the group that was vaccinated using the formalin-inactivated RSV vaccine (see FIG. 17A (for Peribronciolitis and Perivasculitis) and FIG. 17B (for Interstitial Pneumonia and Alveolitis)). The constructs for pre-fusion stabilization according to the invention (F-del_DSCav1_mut2, F-del_DSCav1_mut0, F-del_DSCav1_mut5, F-del_DSCav1_mut4) yielded better responses (lower pathology scores) than F-del. Animals received two vaccinations showed a lower pathology score in comparison to animals only received one vaccination.

Figure 18:
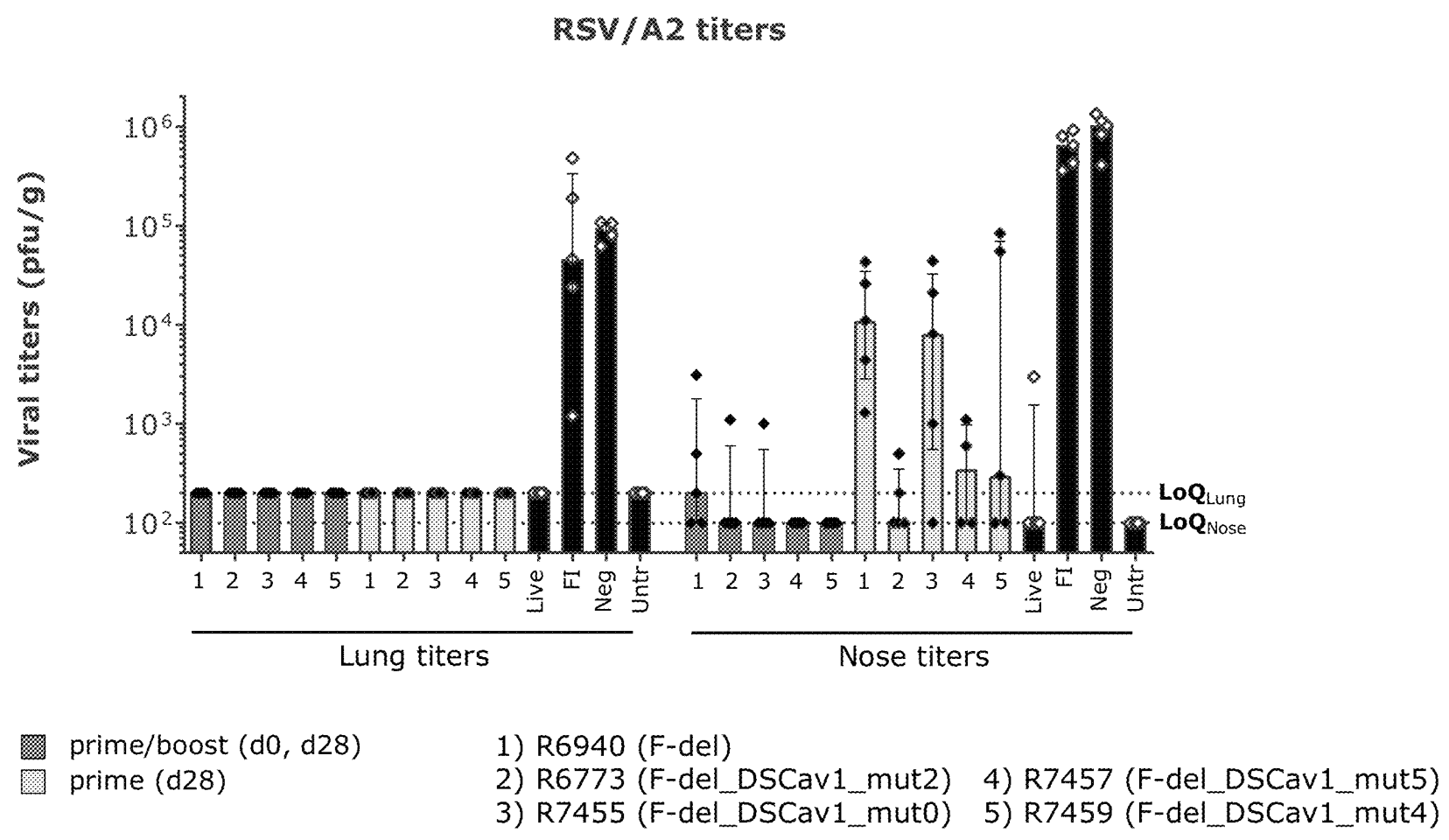

As can be seen from FIG. 18A, all in this experiment tested LNP-formulated RSV-F mRNA vaccines reduced lung viral titers in cotton rats challenged with RSV virus and therefore limit RSV infection of the lung. This ist true even for groups receiving only one vaccination. The results demonstrate protection of vaccinated cotton rats in terms of viral lung titers. By contrast, the formalin-inactivated virus vaccine (FI RSV) reduced only minimally the lung virus titer compared to the buffer control group.

As can be seen from FIG. 18B, the LNP-formulated RSV-F mRNA vaccines strongly reduced viral titers in nasal tissue of cotton rats challenged with RSV virus and therefore reduce RSV infection of the nose. In comparison to the mRNA vaccines the vaccine based on formalin-inactivated virus (FI RSV) was not able to reduce the nasal virus titers. A complete protection of the nose was only achieved for some groups received two vaccinations (e.g. for R7457 (F-del_DSCav_mut4) and R7459 (F-del_DSCav_mut5)).

To conclude, the results show that LNP-formulated RNA constructs encoding pre-fusion stabilized RSV-F truncated proteins (F-del_DSCav1_mut2, F-del_DSCav1_mut0, F-del_DSCav1_mut5, F-del_DSCav1_mut4) raised in general higher functional titers and achieved a more pronounced protection against infection in comparison with the RNA construct coding for the wildtype truncated F protein F_del. The best results were reached by RNA constructs encoding F-del_DSCav1_mut2 or F-del_DSCav1_mut5 (R6773, R7457).

Example 11: Expression of Different RSV T-Cell Antigens Using a Rabbit Reticulocyte Lysate System To determine in vitro protein expression of the mRNA constructs according to the second aspect of the invention (mRNA constructs coding for RSV matrix protein M, phosphoprotein P, nucleoprotein N and matrix protein M2-1 protein), unformulated RNAs (prepared according to Example 1) were mixed with components of Promega Rabbit Reticulocyte Lysate System according to manufacture protocol. The lysate contains the cellular components necessary for protein synthesis (tRNA, ribosomes, amino acids, initiation, elongation and termination factors). As positive control Luciferase RNA from Lysate System Kit was used. The translation result was analyzed by SDS-Page and Western Blot analysis (IRDye 800CW streptavidin antibody (1:2000)). Table 19 summarizes the tested RNA constructs.

TABLE 19

Overview of mRNA constructs used in Example 11

| RNA ID | Antigen | UTR Design | SEQ ID NO: RNA | SEQ ID NO: Protein | Predicted kDa |
|---|---|---|---|---|---|
| R7595 | M | —/muag; i-3 | 10046 | 9684 | |
| R7596 | P | —/muag; i-3 | 10999 | 10637 | 27.1 |
| R7597 | N | —/muag; i-3 | 10496 | 10134 | 43.4 |
| R7598 | M2-1 Luc | —/muag; i-3 | 11545 | 11183 | 22.1 61 |

Figure 19:
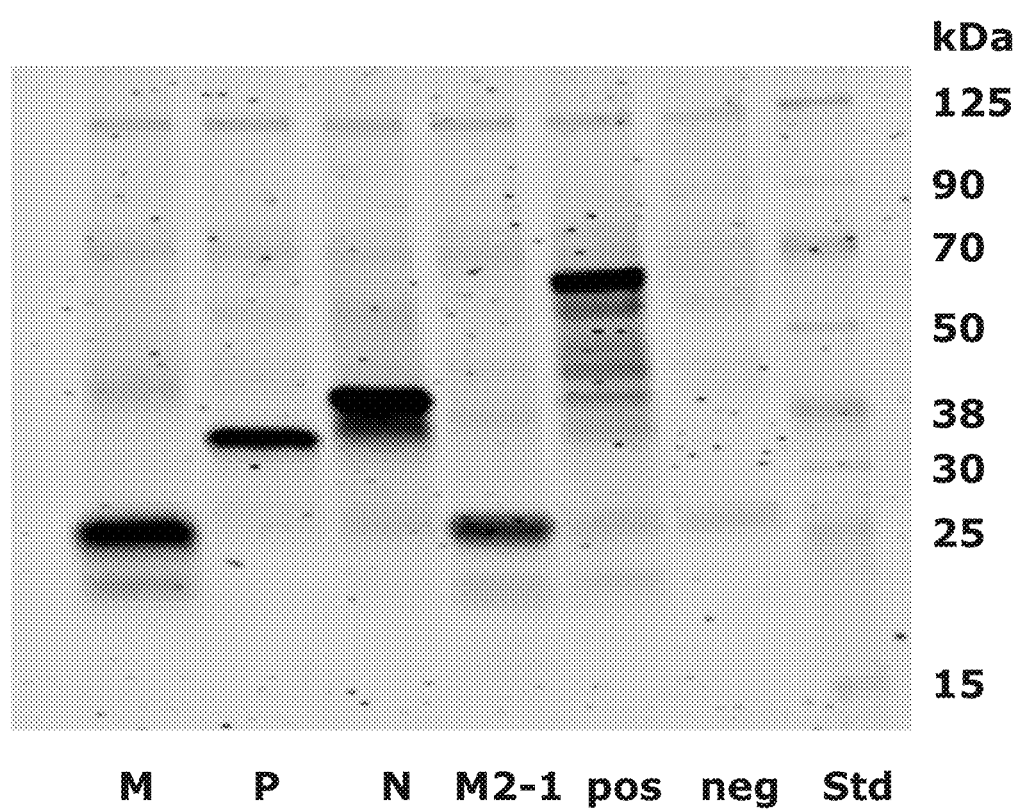
FIG. 19 shows that the used mRNA constructs coding for RSV matrix protein M, phosphoprotein P, nucleoprotein N and matrix protein M2-1 protein led to a detectable protein expression using a rabbit reticulocyte lysate system. Further details are provided in Table 19 and Example 11.

Results:

The results (see FIG. 19) show that the used mRNA constructs led to a detectable protein expression, which is a prerequisite for an mRNA-based RSV vaccine (size shifts of RSV P and M2-1 on the gel may be due to phosphorylation as described e.g. in Richard et al., 2018 or in Hardy and Wertz, 2000 PMIDs: 29489893 and 10846068).

Example 12: Vaccination of Mice with LNP-Formulated mRNA Encoding Different RSV T-Cell Antigens Alone and in the Combination with RSV F (F-Del)

The present Example analyses LNP-formulated mRNA encoding different RSV T-cell antigens according to the second aspect of the invention (RSV M, P, N, and M2-1) alone or in combination with LNP formulated mRNA encoding the truncated RSV F (F-del). The mRNA-LNP vaccines were prepared according to Example 1. Balb/c mice received two intramuscular vaccinations with mRNA-LNP vaccines on days 0 and 28. Each dose comprised 5 µg, 2.5 µg or 2.5 µg+2.5 µg mRNA-LNPs (for groups receiving mRNAs encoding different antigens the LNPs were separately formulated and mixed before administration). Control animals received buffer only (see Table 20).). Humoral, as well as cellular immune responses and neutralizing antibodies were analyzed by ELISA, FACS, PRNT and ICS.

Determination of Anti-RSV F Protein Antibodies by ELISA:

Blood samples were collected on days 0, 14, 28, and 49 for the determination of anti-RSV F antibody titers. ELISA plates were coated with recombinant human RSV fusion glycoprotein (hRSV F Protein (A2; His-tag; Sino Biological; Cat: 11049-V08B)). Coated plates were incubated using given serum dilutions. Binding of specific antibodies to the F protein was detected using isotype specific anti-mouse rat antibodies in combination with streptavidin-HRP (horse radish peroxidase) and the Amplex® UltraRed Reagent (Invitrogen (Ref. No. A36006).

Detection of Antigen-Specific Humoral Antibody Responses Measured by FACS

Figure 21A:
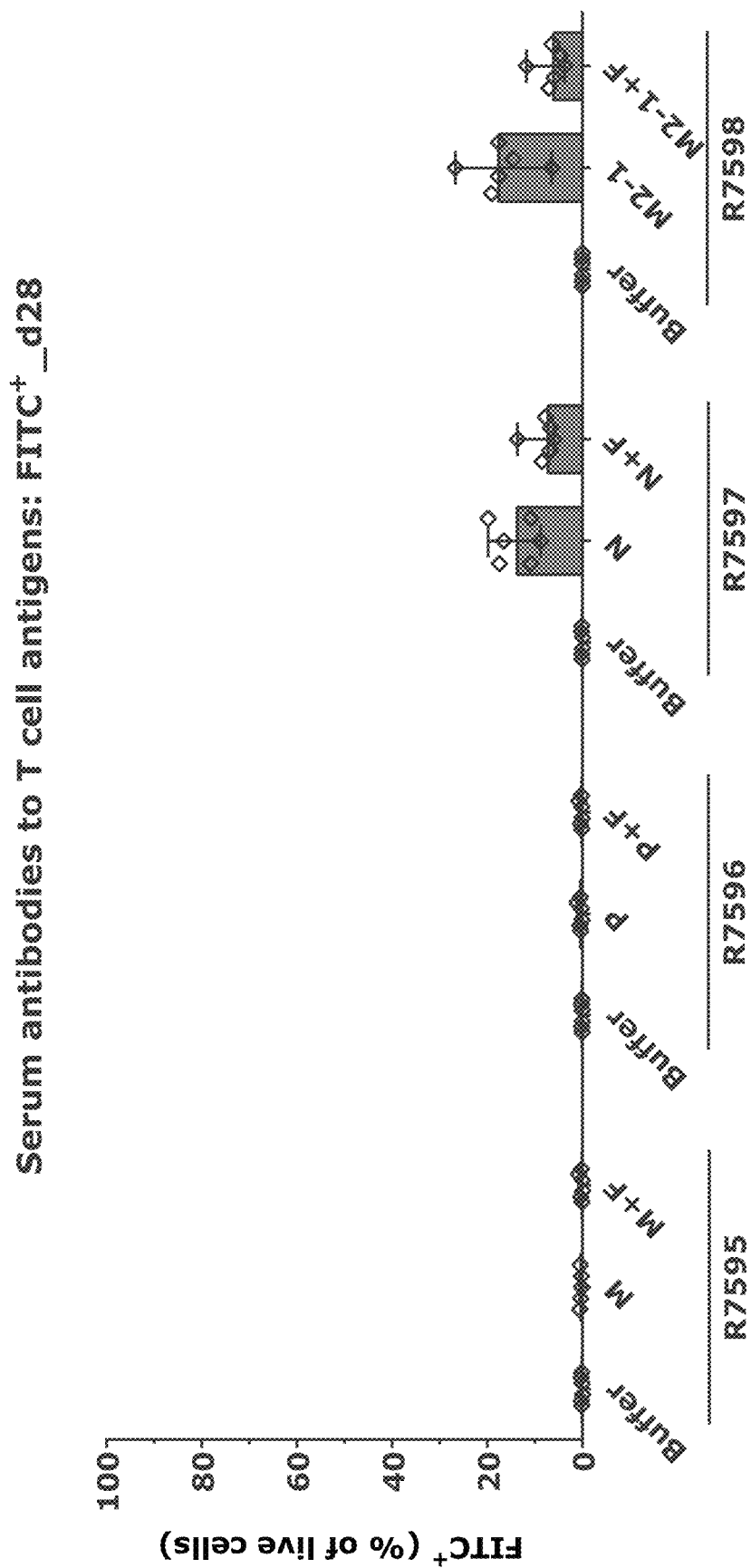
FIGS. 21A-B show that specific antigen IgGs were detected in sera of immunized mice indicating that the applied mRNA constructs are suitable to induce specific humoral immune responses. Vaccination schedule see Table 20. Further details are provided in Example 12.

Hela cells were transfected with 2 µg RSV mRNA constructs (R7595, R7596, R7597, R7598) using lipofectamine. The cells were harvested 20 h post transfection, and seeded at $1 \times 10^5$ per well into a 96 well plate. The cells were incubated with corresponding sera of vaccinated mice (serum of day 28 and 49, diluted 1:50) followed by a FITC-conjugated anti-mouse IgG antibody staining. Cells were acquired on BD FACS Canto II using DIVA software and analyzed by FlowJo. The results are shown in FIG. 21A (day 28) and FIG. 21B (day 49). As read out the percentage of FITC-positive cells (out of live cells) was used.

Determination of Virus Neutralization Titers:

Serum was collected on day 49 and RSV virus neutralization titers (VNTs) were measured using a plaque reduction neutralization test (PRNT). Diluted serum samples were incubated with RSV/A2 (25-50 PFU) for 1 hour at room temperature and inoculated in duplicates onto confluent HEp-2 monolayers in 24 well plates. After one hour incubation at 37° C. in a 5% CO2 incubator, the wells were overlayed with 0.75% Methylcellulose medium. After 4 days of incubation, the overlays were removed and the cells were fixed and stained. The corresponding reciprocal neutralizing antibody titers were determined at the 60% reduction end-point of the virus control.

TABLE 20

Animal groups and vaccination schedule of Example 12

| Group | Test item | RNA ID | SEQ ID NO: RNA | SEQ ID NO: Protein | Dose | Route |
|---|---|---|---|---|---|---|
| 1 | NaCl buffer | — | — | — | | i.m. |
| 2 | M: mRNA encoding RSV M LNP-formulated | R7595 | 10046 | 9684 | 5 µg | i.m. |
| 3 | P: mRNA encoding RSV P LNP-formulated | R7596 | 10999 | 10637 | 5 µg | i.m. |
| 4 | N: mRNA encoding RSV N LNP-formulated | R7597 | 10496 | 10134 | 5 µg | i.m. |
| 5 | M2-1: mRNA encoding M2-1 LNP-formulated | R7598 | 11545 | 11183 | 5 µg | i.m. |
| 6 | F: mRNA encoding F-del LNP-formulated | R6940 | 890 | 483 | 2.5 µg | i.m. |
| 7 | F + M: mRNA encoding F-del + mRNA encoding RSV M LNP-formulated | R7595 + R6940 | 890 + 10046 | 483 + 9684 | 2.5 µg + 2.5 µg | i.m. |
| 8 | F + P: mRNA encoding F-del + mRNA encoding RSV P LNP-formulated | R7596 + R6940 | 890 + 10999 | 483 + 10637 | 2.5 µg + 2.5 µg | i.m. |
| 9 | F + N: mRNA encoding F-del + mRNA encoding RSV N LNP-formulated | R7597 + R6940 | 890 + 10496 | 483 + 10134 | 2.5 µg + 2.5 µg | i.m. |
| 10 | F + M2-1: mRNA encoding F-del + mRNA encoding RSV M2-1 LNP-formulated | R7598 + R6940 | 890 + 11545 | 483 + 11183 | 2.5 µg + 2.5 µg | i.m. |

Determination of Cellular Immune Responses in Mice by ICS Using FACS

Splenocytes and lung cells from vaccinated and control mice were isolated according to standard protocols. Briefly, isolated spleens were grinded through a cell strainer and washed in PBS (1% FCS). After centrifugation, the cell pellet was resuspended with the remaining supernatant, treated with red cell lysis buffer and washed repeatedly with PBS (1% FCS). Finally, splenocytes were resuspended in FCS/10% DMSO, transferred into a cryovial and stored at −80° C. Lungs were perfused using RPMI-1640 medium (10% FCS; 2 mM glutamine; 1% Pen/Strep), harvested, and then stored in RPMI-1640 medium (10% FCS; 2 mM glutamine; 1% Pen/Strep) at 4° C. until lung cells were isolated using the Lung Dissociation Kit mouse from Miltenyi Biotec according to the manufacturer's instructions. For ICS, $2 \times 10^6$ cells (splenocytes or lung cells) were seed in duplicates in round-bottom plates and stimulated with RSV M2-1-specific (VYNTVISYI, SYIGSINNI, SYIESNRKN, KSIDTLSEI), RSV F-specific (FYQSTCSAV, TYMLTNSEL, KYKNAVTEL, KIMTSKTDV), RSF M-specific (KHTATRFAI, AQMPSKFTI, KYIKPQSQF, TYLRSISVR), RSV P-specific (SPITSNSTI, SYEEINDQT), or RSV N-specific (SYKKMLKEM, FYHILNNPK, KYTIQRSTG, GYHVKANGV) peptides. After Golgi block (GolgiPlug 1/1000) and incubation for intracellular cytokine accumulation, cells were subjected to live/dead staining using Aqua-dye. Then, cells were surface stained using the antibodies α-CD8-APC-H7 (1/100), α-CD4-BD-Horizon V450 (1/200), α-Thy1.2-FITC (1/300), and α-CD107a PE-Cy7 (1/100) for splenocytes and α-CD8-APC-H7 (1/100), α-CD4-BD-Horizon V450 (1/200), α-Thy1.2-FITC (1/300), α-CD69-PE (1/100), and α-CD103-PE-Cy7 (1/60) for lung cells. After treatment with Cytofix/Cytoperm, lung cells were intracellularly stained with α-IFNg-APC (1/100) and splenocytes additionally with α-TNFα-PE (1/100). Finally, cells were acquired on BD FACS Canto II using DIVA software and analyzed by FlowJo.

Figure 20A:
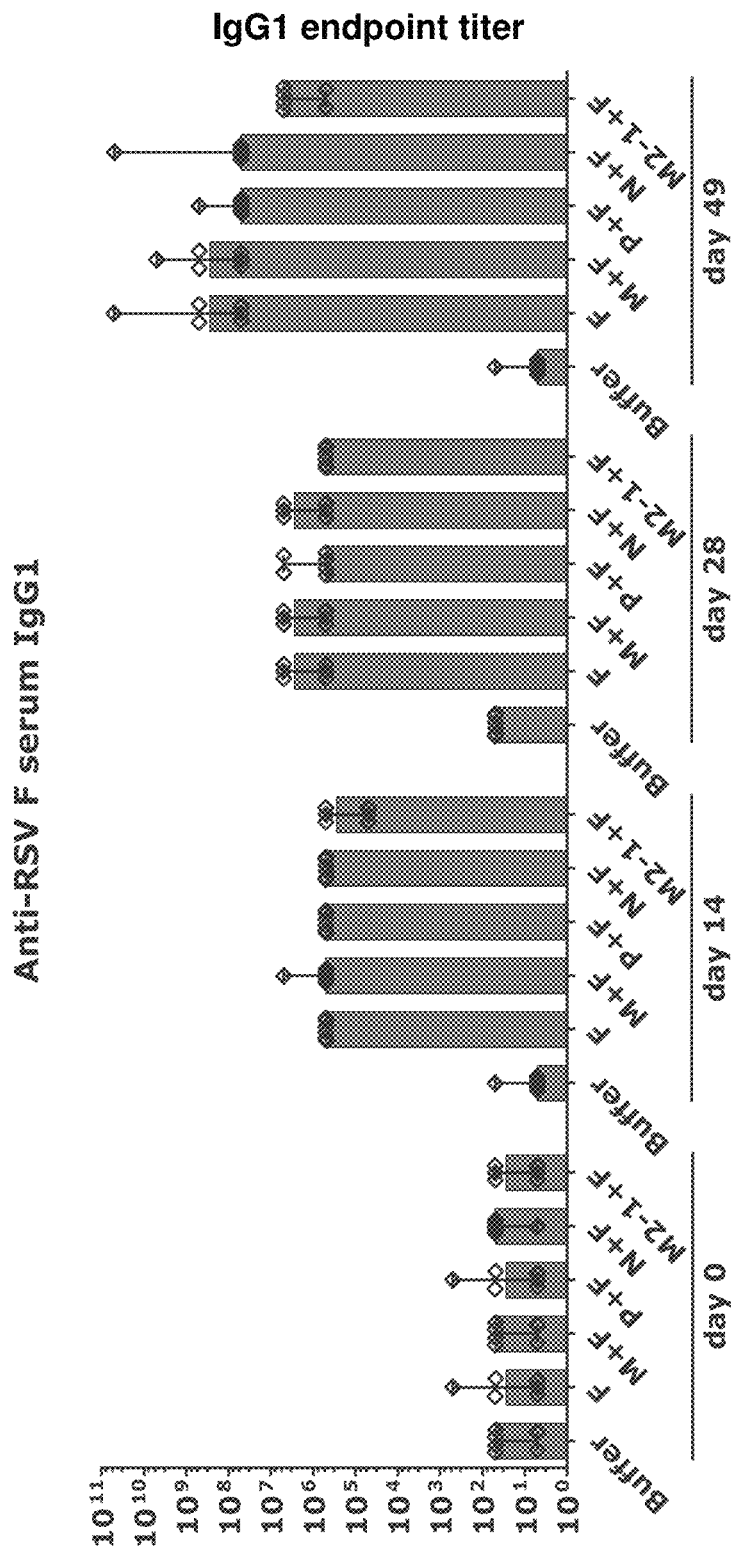
FIGS. 20A-B show the results of the immunogenicity study in mice (ELISA). The humoral immune responses can be seen in FIG. 20A: anti-RSV F IgG and in FIG. 20B: anti-RSV F IgG2a. All groups induced humoral immune responses. In general, the IgG2a titers are 10 times higher than the IgG1 titers, indicating a predominant Th1 response. Vaccination schedule see Table 20. Further details are provided in Example 12.
Figure 20B:
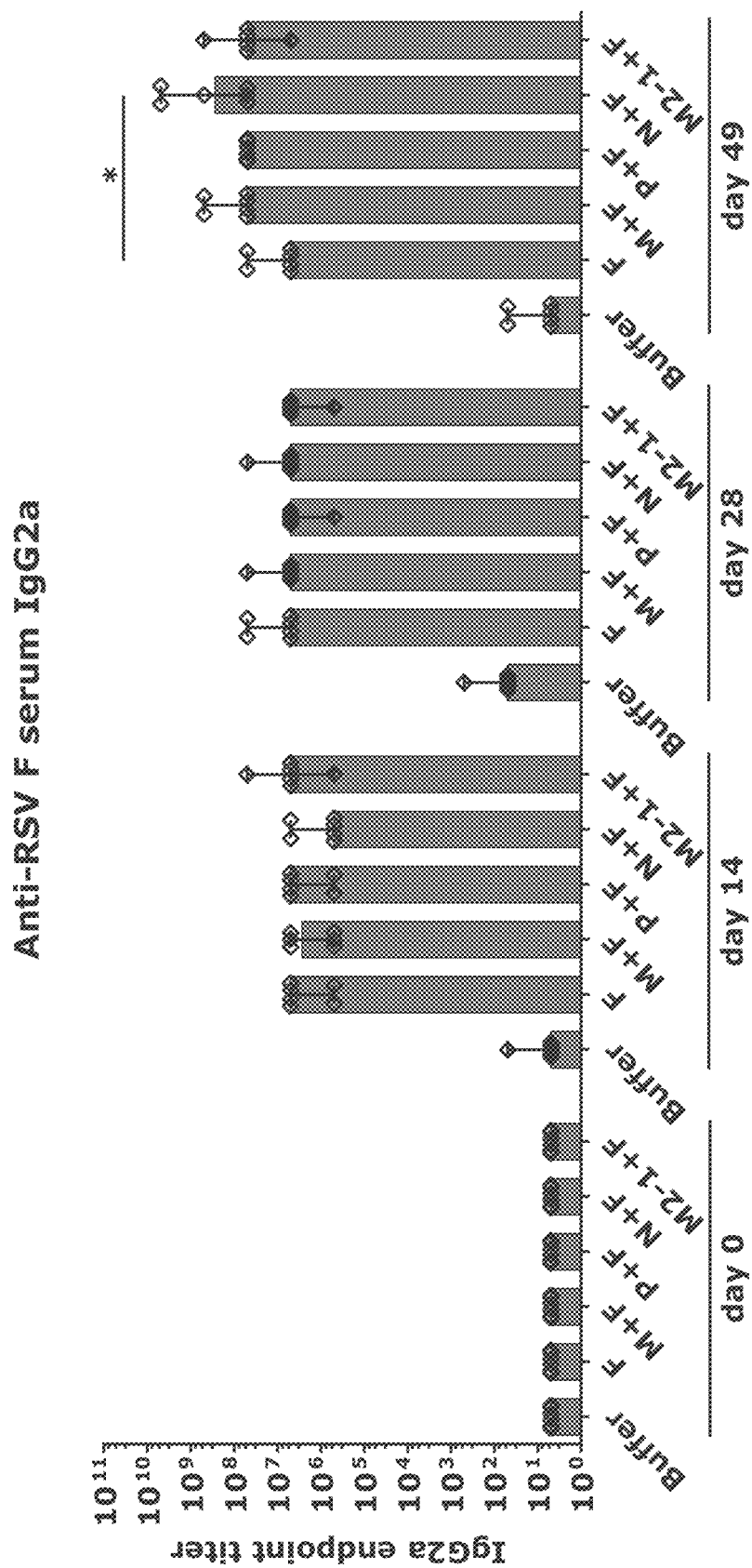

Results:

The results of the immunogenicity study in mice, e.g. the humoral immune responses can be seen in FIG. 20 (FIG. 20A: anti-RSV F IgG, FIG. 20B: anti-RSV F IgG2a). In general, all groups induced humoral immune responses without significant differences between F-del alone and the F-del+T-cell antigen groups. The addition of the T-cell antigens M, P, N, and M2-1 to the mRNA vaccine encoding RSV F-del did not influence or disturb the immune response against RSV F. These findings indicate that the co-expression of T cell antigens does not affect antibody responses induced by RSV F. The immune responses could be boosted by the second immunization (see responses on day 49). In general, the IgG2a titers are 10 times higher than the IgG1 titers, indicating a predominant Th1 response. A Th1-biased immune response is considered to be an important prerequisite for a potential RSV vaccine, as Th2-biased responses have been associated with enhanced respiratory disease (ERD) in animal models.

Figure 21B:
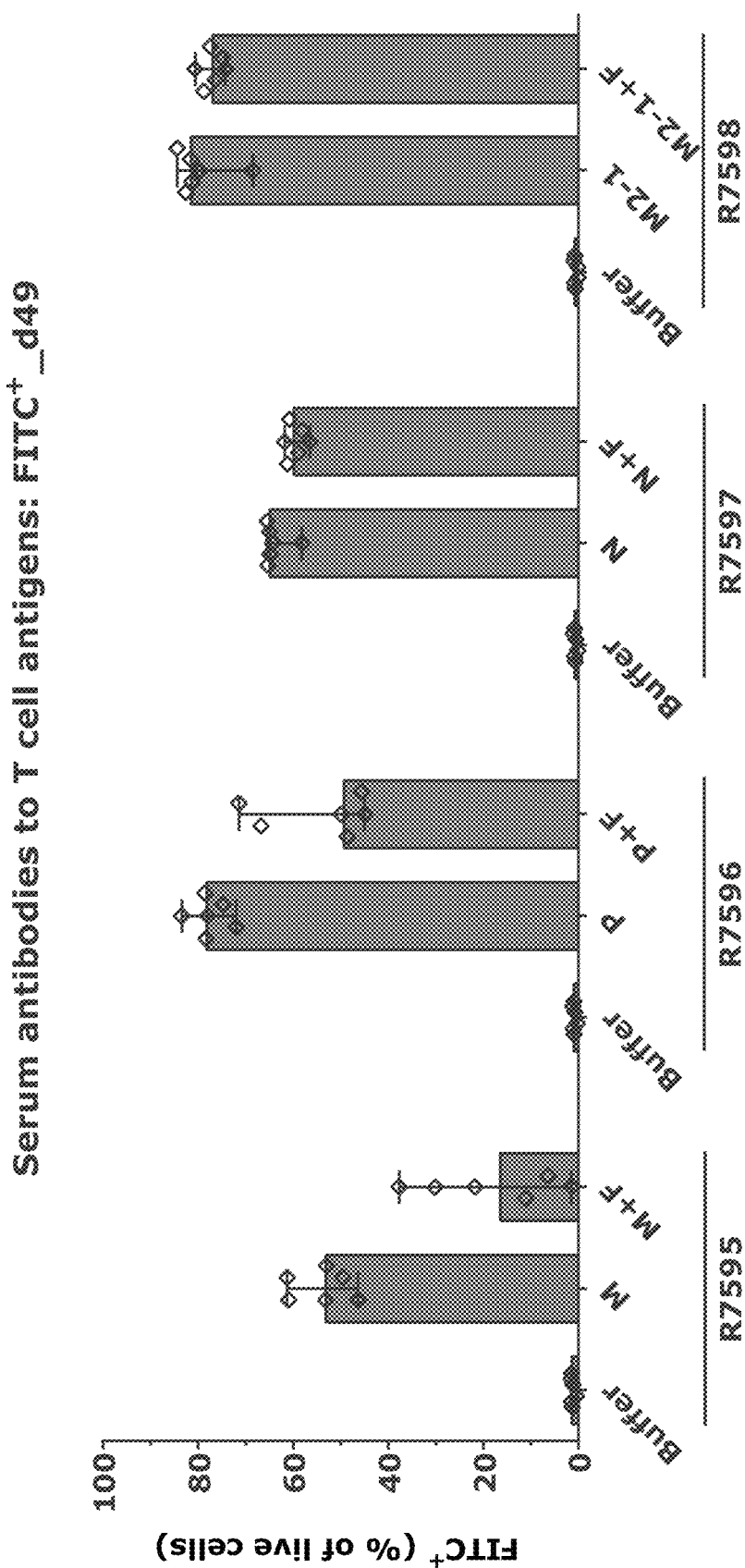

As shown in FIG. 21A and FIG. 21B specific antigen IgGs were detected in sera of immunized mice indicating that the applied mRNA constructs are suitable to induce specific humoral immune responses. Furthermore, the results reveal that the induction of antigen-specific antibody responses for N and M2-1 can already be detected at day 28, while for M and P immunization a boost vaccination is necessary. The decreased antigen-specific antibody responses after RSV F co-immunization are likely due to different immunization doses (5 µg vs, 2.5 µg).

Figure 22:
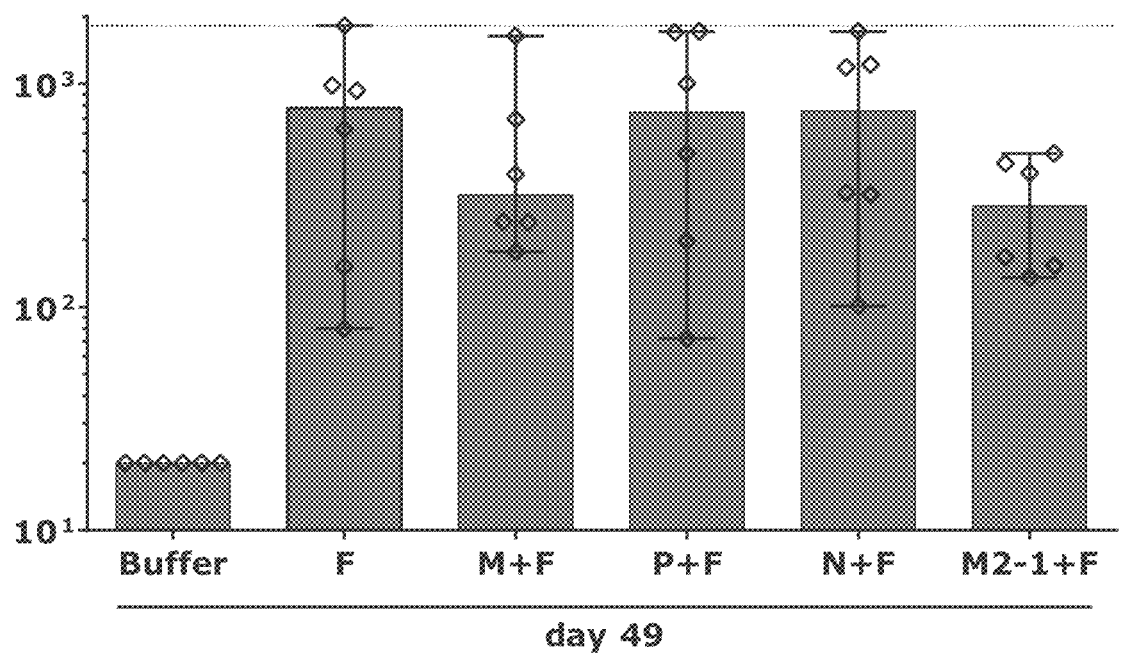
FIG. 22 shows that all LNP-formulated mRNA vaccines (F, M+F, P+F, N+F, M2-1+F) induced the formation of RSV specific functional antibodies in mice as shown by high virus neutralizing antibody titers. Vaccination schedule see Table 20. Further details are provided in Example 12.

As can be seen from FIG. 22, all LNP-formulated mRNA vaccines (F, M+F, P+F, N+F, M2-1+F) induced the formation of RSV specific functional antibodies in mice as shown by high virus neutralizing antibody titers. The serum neutralizing antibody titer assays against RSV/A2 revealed no significant differences between the immunization groups.

Figure 23A:
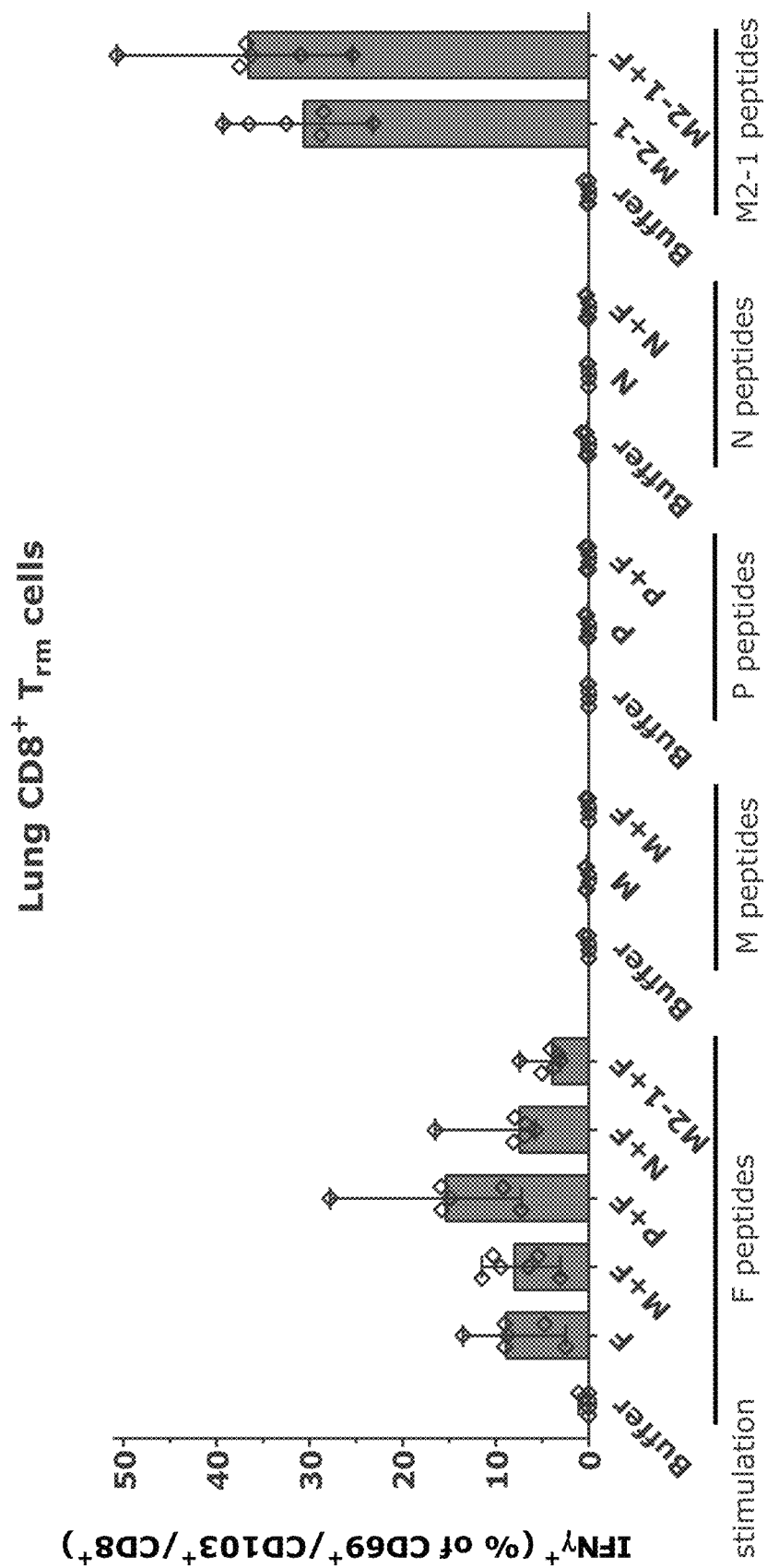
FIGS. 23A-C show that all vaccines containing RSV F, RSV M2-1, or both surprisingly induced a tissue resident memory T cell (TRM) response in the lung upon intramuscular immunization (FIG. 23A). The splenocyte analysis revealed that an immunization with RSV F and especially RSV M2-1 lead to an increase of antigen-specific CD8+ and CD4+ T cells secreting IFN-γ and TNF indicating the induction of a systemic T cell response in addition to a site-specific response (FIG. 23B and FIG. 23C).
Figure 23B:
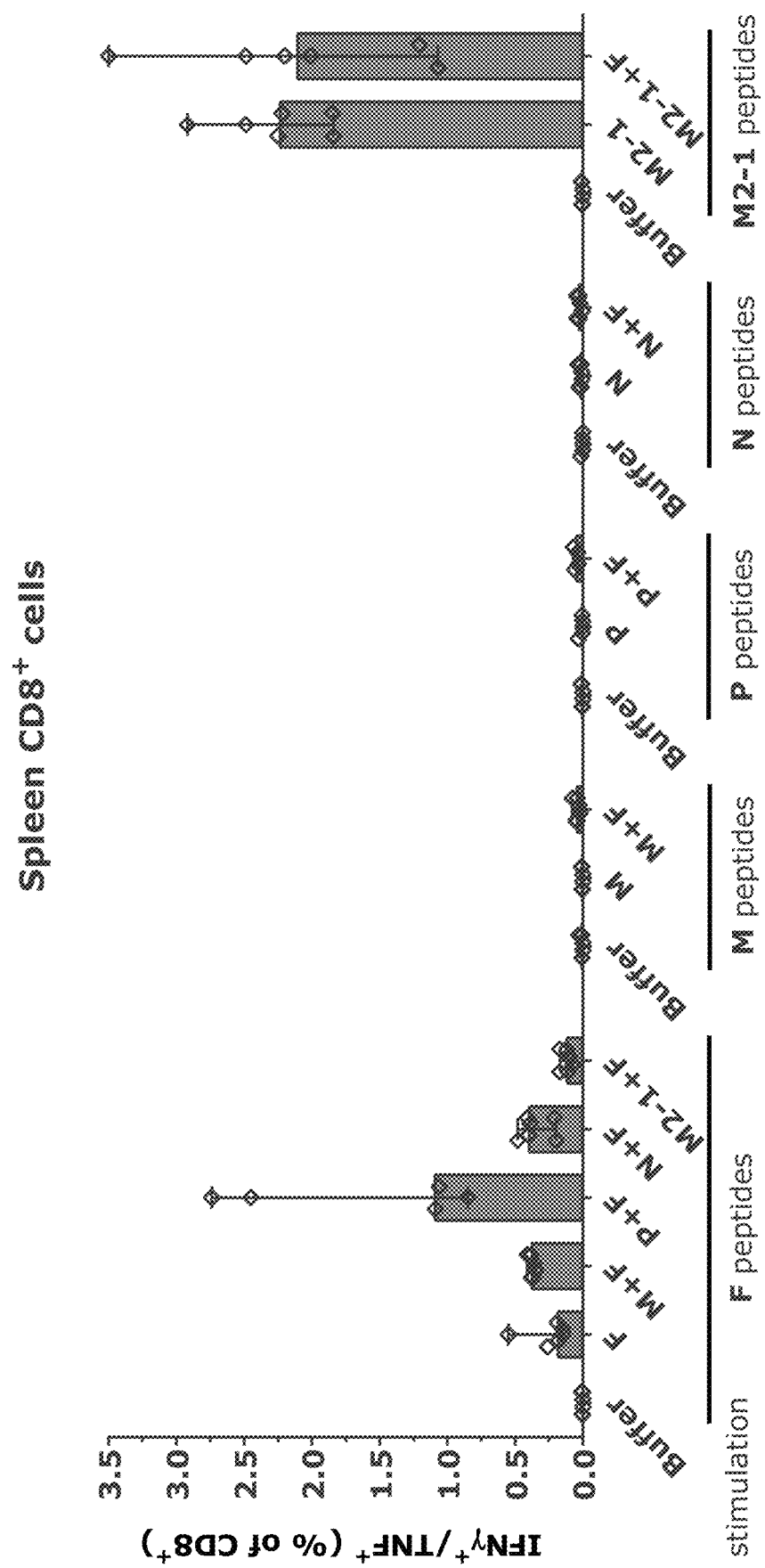
Figure 23C:
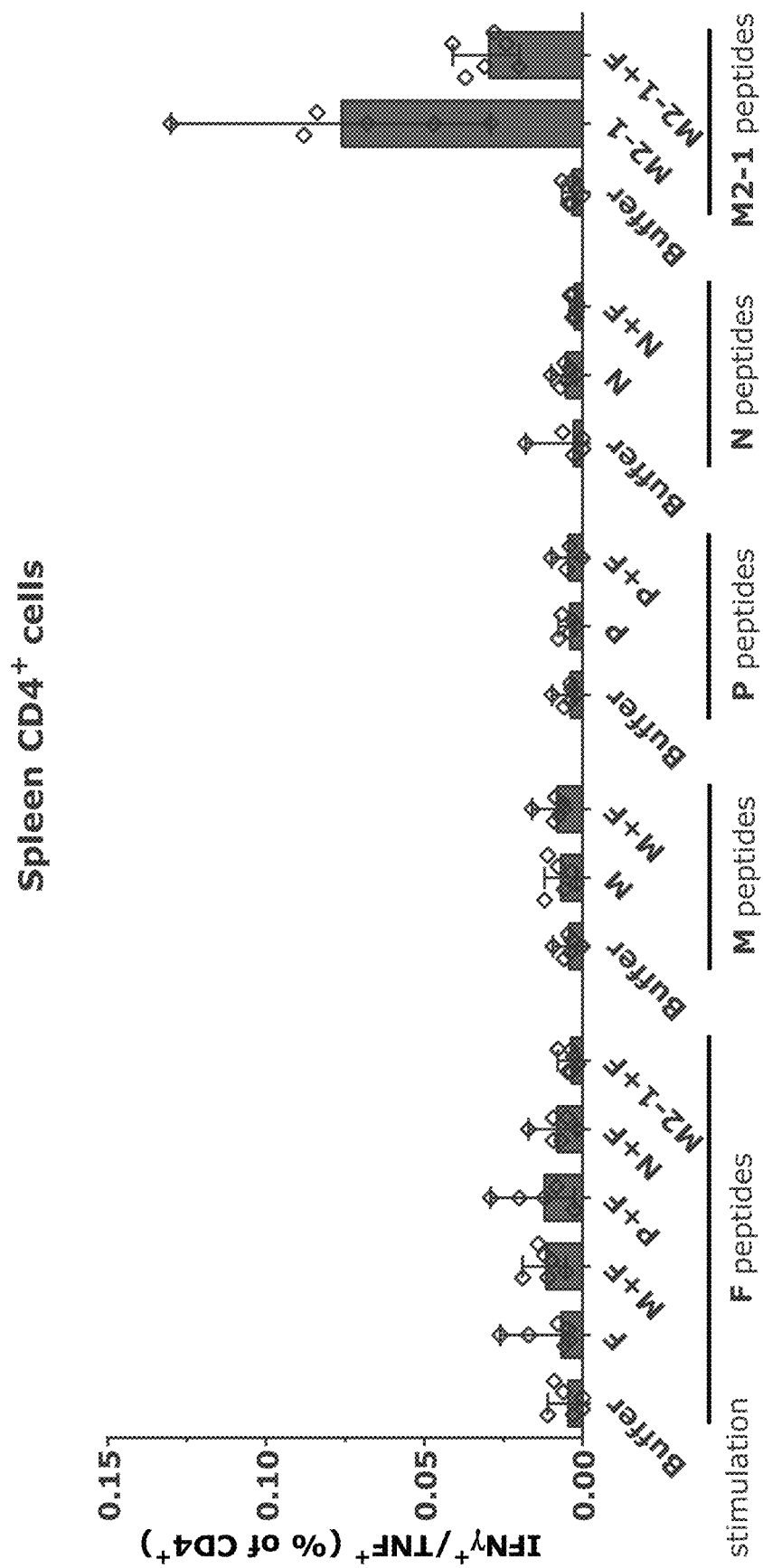

As can be seen from FIG. 23 (FIG. 23A lung ICS CD8, FIG. 23B, spleen ICS CD8, FIG. 23C spleen ICS CD4), all vaccines containing RSV F, RSV M2-1, or both surprisingly induced a tissue resident memory T cell ($T_{RM}$) response in the lung upon intramuscular immunization, as an increase of $CD8^+$ $T_{RM}$ cells specific for F or especially for M2-1 could be observed. The induction of a $T_{RM}$ cell response in the lung might be favorable for a potential RSV vaccine, since lung $T_{RM}$ cells ($CD69^+$ and $CD103^+$) are proposed to protect against RSV infection. The splenocyte analysis revealed that an immunization with RSV F and especially RSV M2-1 lead to an increase of antigen-specific $CD8^+$ and $CD4^+$ T cells secreting IFNγ and TNF indicating the induction of a systemic T cell response in addition to a site-specific response.

To conclude, the results show that RSV M2-1 induces the most promising T cell immune responses without affecting antibody responses induced by RSV F. Thus, a vaccine containing mRNAs encoding for RSV F in combination with RSV M2-1 might increase the protective efficacy against RSV infection.

Example 13: Clinical Development of a RSV mRNA Vaccine Composition

To demonstrate safety and efficiency of the RSV mRNA vaccine composition, a clinical trial (phase I) is initiated. For clinical development, RNA is used that has been produced under GMP conditions (e.g. using a procedure as described in WO2016/180430).

In the clinical trial, a cohort of healthy human volunteers is intramuscularly injected with respective LNP formulated vaccine compositions comprising favorable UTR combinations.

In order to assess the safety profile of the vaccine compositions according to the invention, subjects are monitored after administration (vital signals, vaccination site tolerability assessments, hematologic analysis).

The efficacy of the immunization is analyzed by determination of virus neutralizing titers (VNT) in sera from vaccinated subjects. Blood samples are collected on day 0 as baseline and after completed vaccination. Sera are analyzed for virus neutralizing antibodies.

SEQUENCE LISTING (21706 sequences)

SEQ ID NO: 1 - DNA, 62 bp, synthetic construct
  misc_feature 1..62: note = 5'-UTR of human peroxisomal multifunctional enzyme type 2 lacking the 5'-terminal oligopyrimidine tract (HSD17B4)
  source 1..62: mol_type = other DNA
gtcccgcagtcggcgtccagcggctctgcttgttcgtgtgtgtgtcgttgcaggccttattc

SEQ ID NO: 2 - RNA, 62 nt, synthetic construct
  misc_feature 1..62: note = 5'-UTR of human peroxisomal multifunctional enzyme type 2 lacking the 5'-terminal oligopyrimidine tract (HSD17B4) mRNA
  source 1..62: mol_type = other RNA
gtcccgcagtcggcgtccagcggctctgcttgttcgtgtgtgtgtcgttgcaggccttattc

SEQ ID NO: 3 - DNA, 42 bp, synthetic construct
  misc_feature 1..42: note = 5'-UTR of human acid ceramidase lacking the 5'-terminal oligopyrimidine tract (ASAH1)
  source 1..42: mol_type = other DNA
gcctctgctggagtccggggagtggcgttggctgctagagcg

SEQ ID NO: 4 - RNA, 42 nt, synthetic construct
  misc_feature 1..42: note = 5'-UTR of human acid ceramidase lacking the 5'-terminal oligopyrimidine tract (ASAH1) mRNA
  source 1..42: mol_type = other RNA
gcctctgctggagtccggggagtggcgttggctgctagagcg

SEQ ID NO: 5 - DNA, 75 bp, synthetic construct
  misc_feature 1..75: note = 5'-UTR of human mitochondrial ATP synthase subunit alpha lacking the 5'-terminal oligopyrimidine tract (ATP5A1)
  source 1..75: mol_type = other DNA
gcggctcggccattttgtcccagtcagtccggaggctgcggctgcagaagtaccgcctgcggagtaactgcaaag

SEQ ID NO: 6 - RNA, 75 nt, synthetic construct
  misc_feature 1..75: note = 5'-UTR of human mitochondrial ATP synthase subunit alpha lacking the 5'-terminal oligopyrimidine tract (ATP5A1) mRNA
  source 1..75: mol_type = other RNA
gcggctcggccattttgtcccagtcagtccggaggctgcggctgcagaagtaccgcctgcggagtaactgcaaag

SEQ ID NO: 7 - DNA, 54 bp, synthetic construct
  misc_feature 1..54: note = 5'-UTR of mouse RIKEN cDNA 2010107E04 gene (Mp68, 2010107E04Rik)
  source 1..54: mol_type = other DNA
ctttcccattctgtagcagaatttggtgttgcctgtggtcttggtcccgcggag

SEQ ID NO: 8 - RNA, 54 nt, synthetic construct
  misc_feature 1..54: note = 5'-UTR of mouse RIKEN cDNA 2010107E04 gene (Mp68, 2010107E04Rik) mRNA
  source 1..54: mol_type = other RNA
ctttcccattctgtagcagaatttggtgttgcctgtggtcttggtcccgcggag

SEQ ID NO: 9 - DNA, 81 bp, synthetic construct
  misc_feature 1..81: note = 5'-UTR of mouse NADH dehydrogenase (ubiquinone) 1 alpha subcomplex, 4 (Ndufa4)
  source 1..81: mol_type = other DNA
gtccgctcagccaggttgcagaagcggcttagcgtgtgtcctaatcttctctctgcgtgtaggtaggcctgtgccgcaaac

SEQ ID NO: 10 - RNA, 81 nt, synthetic construct
  misc_feature 1..81: note = 5'-UTR of mouse NADH dehydrogenase (ubiquinone) 1 alpha subcomplex, 4 (Ndufa4) mRNA
  source 1..81: mol_type = other RNA
gtccgctcagccaggttgcagaagcggcttagcgtgtgtcctaatcttctctctgcgtgtaggtaggcctgtgccgcaaac

SEQ ID NO: 11 - DNA, 108 bp, synthetic construct
  misc_feature 1..108: note = 5'-UTR of mouse nitric oxide synthase interacting protein (Nosip)
  source 1..108: mol_type = other DNA
ctcctgtcgggcggaagtaggaggagtagagtttaaaaacagtactctttttccggttcgggacgtagttgaagcaacgacaagccggataaccgctcttgagacagg

SEQ ID NO: 12 - RNA, 108 nt, synthetic construct
  misc_feature 1..108: note = 5'-UTR of mouse nitric oxide synthase interacting protein (Nosip) mRNA
  source 1..108: mol_type = other RNA
ctcctgtcgggcggaagtaggaggagtagagtttaaaaacagtactctttttccggttcgggacgtagttgaagcaacgacaagccggataaccgctcttgagacagg

SEQ ID NO: 13 - DNA, 84 bp, synthetic construct
  misc_feature 1..84: note = 5'-UTR of mouse ribosomal protein L31 (Rpl31)
  source 1..84: mol_type = other DNA
cccgtgacccggaagttgtacggctacgcgactttccctcccacaaaccctcgcgcccttcctttcctacttgggcccggcaga

SEQ ID NO: 14 - RNA, 84 nt, synthetic construct
  misc_feature 1..84: note = 5'-UTR of mouse ribosomal protein L31 (Rpl31) mRNA
  source 1..84: mol_type = other RNA
cccgtgacccggaagttgtacggctacgcgactttccctcccacaaaccctcgcgcccttcctttcctacttgggcccggcaga

SEQ ID NO: 15 - DNA, 159 bp, synthetic construct
  misc_feature 1..159: note = 5'-UTR of mouse solute carrier family 7 (cationic amino acid transporter, y+ system), member 3 (Slc7a3)
  source 1..159: mol_type = other DNA
gggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactaga

SEQ ID NO: 16 - RNA, 159 nt, synthetic construct
  misc_feature 1..159: note = 5'-UTR of mouse solute carrier family 7 (cationic amino acid transporter, y+ system), member 3 (Slc7a3) mRNA
  source 1..159: mol_type = other RNA
gggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactaga

SEQ ID NO: 17 - DNA, 102 bp, synthetic construct
  misc_feature 1..102: note = 5'-UTR of human tubulin beta 4B class Ivb (TUBB4B)
  source 1..102: mol_type = other DNA
atataagcgttggcggagcgtcggttgtagcactctgcgcgcccgctcttctgctgctgtttgtctacttcctcctgcttccccgccgccgccgccgccatc

SEQ ID NO: 18 - RNA, 102 nt, synthetic construct
  misc_feature 1..102: note = 5'-UTR of human tubulin beta 4B class Ivb (TUBB4B) mRNA
  source 1..102: mol_type = other RNA
atataagcgttggcggagcgtcggttgtagcactctgcgcgcccgctcttctgctgctgtttgtctacttcctcctgcttccccgccgccgccgccgccatc

SEQ ID NO: 19 - DNA, 222 bp, synthetic construct
  misc_feature 1..222: note = 5'-UTR of mouse ubiquilin 2 (Ubqln2)
  source 1..222: mol_type = other DNA
cggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgcc

SEQ ID NO: 20 - RNA, 222 nt, synthetic construct
  misc_feature 1..222: note = 5'-UTR of mouse ubiquilin 2 (Ubqln2) mRNA
  source 1..222: mol_type = other RNA
cggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgcc

SEQ ID NO: 21 - DNA, 42 bp, synthetic construct
  misc_feature 1..42: note = 5'-UTR of human ribosomal protein Large 32 lacking the 5'-terminal oligopyrimidine tract (RPL32, 32L4)
  source 1..42: mol_type = other DNA
ggcgctgcctacggaggtggcagccatctccttctcggcatc

SEQ ID NO: 22 - RNA, 42 nt, synthetic construct
  misc_feature 1..42: note = 5'-UTR of human ribosomal protein Large 32 lacking the 5'-terminal oligopyrimidine tract (RPL32, 32L4) mRNA
  source 1..42: mol_type = other RNA
ggcgctgcctacggaggtggcagccatctccttctcggcatc

SEQ ID NO: 23 - DNA, 57 bp, synthetic construct
  misc_feature 1..57: note = 3'-UTR of human proteasome subunit beta 3 (PSMB3)
  source 1..57: mol_type = other DNA
ccctgttcccagagcccacttttttttctttttttgaaataaaatagcctgtctttc

SEQ ID NO: 24 - RNA, 57 nt, synthetic construct
  misc_feature 1..57: note = 3'-UTR of human proteasome subunit beta 3 (PSMB3) mRNA
  source 1..57: mol_type = other RNA
ccctgttcccagagcccacttttttttctttttttgaaataaaatagcctgtctttc

SEQ ID NO: 25 - DNA, 121 bp, synthetic construct
  misc_feature 1..121: note = 3'-UTR of human caspase 1 (CASP1)
  source 1..121: mol_type = other DNA
aataaggaaactgtatgaatgtctgtgggcaggaagtgaagagatccttctgtaaaggtttttggaattatgtctgctgaataataaacttttttgaaataataaatctggtagaaaaatg

SEQ ID NO: 26 - RNA, 121 nt, synthetic construct
  misc_feature 1..121: note = 3'-UTR of human caspase 1 (CASP1) mRNA
  source 1..121: mol_type = other RNA
aataaggaaactgtatgaatgtctgtgggcaggaagtgaagagatccttctgtaaaggtttttggaattatgtctgctgaataataaacttttttgaaataataaatctggtagaaaaatg

SEQ ID NO: 27 - DNA, 137 bp, synthetic construct
  misc_feature 1..137: note = 3'-UTR of human cytochrome c oxidase subunit 6B1 (COX6B1)
  source 1..137: mol_type = other DNA
actggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 28 - RNA, 137 nt, synthetic construct
  misc_feature 1..137: note = 3'-UTR of human cytochrome c oxidase subunit 6B1 (COX6B1) mRNA
  source 1..137: mol_type = other RNA
actggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 29 - DNA, 353 bp, synthetic construct
  misc_feature 1..353: note = 3'-UTR of mouse GNAS (guanine nucleotide binding protein, alpha stimulating) complex locus (Gnas)
  source 1..353: mol_type = other DNA
gaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagca

SEQ ID NO: 30 - RNA, 353 nt, synthetic construct
  misc_feature 1..353: note = 3'-UTR of mouse GNAS (guanine nucleotide binding protein, alpha stimulating) complex locus (Gnas) mRNA
  source 1..353: mol_type = other RNA
gaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagca

SEQ ID NO: 31 - DNA, 133 bp, synthetic construct
  misc_feature 1..133: note = 3'-UTR of mouse NADH dehydrogenase (ubiquinone) 1 alpha subcomplex, 1 (Ndufa1)
  source 1..133: mol_type = other DNA
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 32 - RNA, 133 nt, synthetic construct
  misc_feature 1..133: note = 3'-UTR of mouse NADH dehydrogenase (ubiquinone) 1 alpha subcomplex, 1 (Ndufa1) mRNA
  source 1..133: mol_type = other RNA
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 33 - DNA, 70 bp, synthetic construct
  misc_feature 1..70: note = 3'-UTR of human ribosomal protein S9 (RPS9)
  source 1..70: mol_type = other DNA
gtccacctgtccctcctgggctgctggattgtctcgttttcctgccaaataaacaggatcagcgctttac

SEQ ID NO: 34 - RNA, 70 nt, synthetic construct
  misc_feature 1..70: note = 3'-UTR of human ribosomal protein S9 (RPS9) mRNA
  source 1..70: mol_type = other RNA
gtccacctgtccctcctgggctgctggattgtctcgttttcctgccaaataaacaggatcagcgctttac

SEQ ID NO: 35 - DNA, 187 bp, synthetic construct
  misc_feature 1..187: note = 3'-UTR ALB7
  source 1..187: mol_type = other DNA
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 36 - RNA, 187 nt, synthetic construct
  misc_feature 1..187: note = 3'-UTR ALB7 mRNA
  source 1..187: mol_type = other RNA
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 37 - DNA, 44 bp, synthetic construct
  misc_feature 1..44: note = Center, alpha-complex-binding portion of the 3'-UTR of an alpha-globin gene (muag)
  source 1..44: mol_type = other DNA
gcccgatgggcctcccaacgggccctcctcccctccttgcaccg

SEQ ID NO: 38 - RNA, 44 nt, synthetic construct
  misc_feature 1..44: note = Center, alpha-complex-binding portion of the 3'-UTR of an alpha-globin gene (muag) mRNA
  source 1..44: mol_type = other RNA
gcccgatgggcctcccaacgggccctcctcccctccttgcaccg

SEQ ID NO: 39 - DNA, 24 bp, synthetic construct
  misc_feature 1..24: note = histone stem-loop sequence (histoneSL, hSL)
  source 1..24: mol_type = other DNA
caaaggctcttttcagagccacca

SEQ ID NO: 40 - RNA, 24 nt, synthetic construct
  misc_feature 1..24: note = histone stem-loop sequence (histoneSL, hSL) mRNA
  source 1..24: mol_type = other RNA
caaaggctcttttcagagccacca

SEQ ID NO: 41 - DNA, 13 bp, synthetic construct
  misc_feature 1..13: note = Kozak
  source 1..13: mol_type = other DNA
gccgccaccatgg

SEQ ID NO: 42 - RNA, 13 nt, synthetic construct
  misc_feature 1..13: note = Kozak mRNA
  source 1..13: mol_type = other RNA
gccgccaccatgg

SEQ ID NO: 43 - skipped

SEQ ID NO: 44 - RNA, 99 nt, synthetic construct
  misc_feature 1..99: note = mRNA 3'-end A75-histoneSL
  source 1..99: mol_type = other RNA
aaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 45 - RNA, 102 nt, synthetic construct
  misc_feature 1..102: note = mRNA 3'-end U3-A75-histoneSL
  source 1..102: mol_type = other RNA
tttaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 46 - RNA, 178 nt, synthetic construct
  misc_feature 1..178: note = mRNA 3'-end A154-histoneSL
  source 1..178: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 47 - RNA, 181 nt, synthetic construct
  misc_feature 1..181: note = mRNA 3'-end U3-A154-histoneSL
  source 1..181: mol_type = other RNA
tttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 48 - RNA, 101 nt, synthetic construct
  misc_feature 1..101: note = mRNA 3'-end N2-A75-histoneSL
  source 1..101: mol_type = other RNA
agaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 49 - RNA, 99 nt, synthetic construct
  misc_feature 1..99: note = mRNA 3'-end histoneSL-A75
  source 1..99: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaa

SEQ ID NO: 50 - RNA, 124 nt, synthetic construct
  misc_feature 1..124: note = mRNA 3'-end histoneSL-A100
  source 1..124: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 51 - RNA, 170 nt, synthetic construct
  misc_feature 1..170: note = mRNA 3'-end histoneSL-A146
  source 1..170: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 52 - RNA, 136 nt, synthetic construct
  misc_feature 1..136: note = mRNA 3'-end N8-A64-N5-C30-histoneSL-N5
  source 1..136: mol_type = other RNA
agattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 53 - RNA, 131 nt, synthetic construct
  misc_feature 1..131: note = mRNA 3'-end N8-A64-N5-C30-histoneSL
  source 1..131: mol_type = other RNA
agattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccacca

SEQ ID NO: 54 - RNA, 105 nt, synthetic construct
  misc_feature 1..105: note = mRNA 3'-end N8-A64-N5-C4-histoneSL
  source 1..105: mol_type = other RNA
agattaataaaaaaaaaaaaaaaaaaaaaaaaaaaaaaaaaaaaaaaaaaaaaaaaaaaaaaaaaaaaaaaatgcatcccccaaaggctcttttcagagccacca

SEQ ID NO: 55 - RNA, 115 nt, synthetic construct
  misc_feature 1..115: note = mRNA 3'-end N8-A64-N5-C14-histoneSL
  source 1..115: mol_type = other RNA
agattaataaaaaaaaaaaaaaaaaaaaaaaaaaaaaaaaaaaaaaaaaaaaaaaaaaaaaaaaaaaaaaaatgcatcccccccccccccccaaaggctcttttcagagccacca

SEQ ID NO: 56 - RNA, 134 nt, synthetic construct
  misc_feature 1..134: note = mRNA 3'-end N6-A64-N5-C30-histoneSL-N5
  source 1..134: mol_type = other RNA
agatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 57 - RNA, 129 nt, synthetic construct
  misc_feature 1..129: note = mRNA 3'-end N6-A64-N5-C30-histoneSL
  source 1..129: mol_type = other RNA
agatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccacca

SEQ ID NO: 58 - RNA, 103 nt, synthetic construct
  misc_feature 1..103: note = mRNA 3'-end N6-A64-N5-C4-histoneSL
  source 1..103: mol_type = other RNA
agatctaaaaaaaaaaaaaaaaaaaaaaaaaaaaaaaaaaaaaaaaaaaaaaaaaaaaaaaaaaaaaaaatgcatcccccaaaggctcttttcagagccacca

SEQ ID NO: 59 - RNA, 113 nt, synthetic construct
  misc_feature 1..113: note = mRNA 3'-end N6-A64-N5-C14-histoneSL
  source 1..113: mol_type = other RNA
agatctaaaaaaaaaaaaaaaaaaaaaaaaaaaaaaaaaaaaaaaaaaaaaaaaaaaaaaaaaaaaaaaatgcatcccccccccccccccaaaggctcttttcagagccacca

SEQ ID NO: 60 - RNA, 128 nt, synthetic construct
  misc_feature 1..128: note = mRNA 3'-end A64-N5-C30-histoneSL-N5
  source 1..128: mol_type = other RNA
aaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61 - RNA, 123 nt, synthetic construct
  misc_feature 1..123: note = mRNA 3'-end A64-N5-C30-histoneSL
  source 1..123: mol_type = other RNA
aaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccacca

SEQ ID NO: 62 - RNA, 97 nt, synthetic construct
  misc_feature 1..97: note = mRNA 3'-end A64-N5-C4-histoneSL
  source 1..97: mol_type = other RNA
aaaaaaaaaaaaaaaaaaaaaaaaaaaaaaaaaaaaaaaaaaaaaaaaaaaaaaaaaaaaaaaatgcatcccccaaaggctcttttcagagccacca

SEQ ID NO: 63 - RNA, 107 nt, synthetic construct
  misc_feature 1..107: note = mRNA 3'-end A64-N5-C14-histoneSL
  source 1..107: mol_type = other RNA
aaaaaaaaaaaaaaaaaaaaaaaaaaaaaaaaaaaaaaaaaaaaaaaaaaaaaaaaaaaaaaaatgcatcccccccccccccccaaaggctcttttcagagccacca

SEQ ID NO: 64 - protein, 14 aa, synthetic construct
  REGION 1..14: note = derived and/or modified protein sequence (artificial) from Artificial__carrier peptide 1
CRRRRRRRRRRRRC

SEQ ID NO: 65 - protein, 13 aa, synthetic construct
  REGION 1..13: note = derived and/or modified protein sequence (artificial) from Artificial__carrier peptide 2
CRRRRRRRRRRRR

SEQ ID NO: 66 - protein, 14 aa, synthetic construct
  REGION 1..14: note = derived and/or modified protein sequence (artificial) from Artificial__carrier peptide 3
WRRRRRRRRRRRRC

SEQ ID NO: 67 - protein, 18 aa, synthetic construct
  REGION 1..18: note = derived and/or modified protein sequence (artificial) from Artificial__carrier peptide 4
CHHHHHHRRRRHHHHHHC

SEQ ID NO: 68 - protein, 574 aa, synthetic construct
  REGION 1..574: note = derived and/or modified protein sequence (artificial) from HRSV(A2)__F0
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 69 - RNA, 1725 nt, synthetic construct
  misc_feature 1..1725: note = derived and/or modified CDS sequence (artificial) from HRSV(A2)__F0
  source 1..1725: mol_type = other RNA
atggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaa

SEQ ID NO: 70 - RNA, 1725 nt, synthetic construct
  misc_feature 1..1725: note = derived and/or modified CDS sequence (opt1) from HRSV(A2)__F0
  source 1..1725: mol_type = other RNA
atggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 71 - RNA, 1725 nt, synthetic construct
  misc_feature 1..1725: note = derived and/or modified CDS sequence (opt1) from HRSV(A2)__F0
  source 1..1725: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactga

SEQ ID NO: 72 - RNA, 1725 nt, synthetic construct
  misc_feature 1..1725: note = derived and/or modified CDS sequence (opt2) from HRSV(A2)__F0
  source 1..1725: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 73 - RNA, 1725 nt, synthetic construct
  misc_feature 1..1725: note = derived and/or modified CDS sequence (opt3) from HRSV(A2)__F0
  source 1..1725: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactga

SEQ ID NO: 74 - RNA, 1725 nt, synthetic construct
  misc_feature 1..1725: note = derived and/or modified CDS sequence (opt4) from HRSV(A2)__F0
  source 1..1725: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 75 - RNA, 1725 nt, synthetic construct
  misc_feature 1..1725: note = derived and/or modified CDS sequence (opt5) from HRSV(A2)__F0
  source 1..1725: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactga

SEQ ID NO: 76 - RNA, 1725 nt, synthetic construct
  misc_feature 1..1725: note = derived and/or modified CDS sequence (opt6) from HRSV(A2)__F0
  source 1..1725: mol_type = other RNA
atggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaa

SEQ ID NO: 77 - RNA, 1725 nt, synthetic construct
  misc_feature 1..1725: note = derived and/or modified CDS sequence (opt11) from HRSV(A2)__F0
  source 1..1725: mol_type = other RNA
atggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaa

SEQ ID NO: 78 - RNA, 2001 nt, synthetic construct
  misc_feature 1..2001: note = mRNA product Design a-1 comprising derived and/or modified sequence from HRSV(A2)__F0 (artificial)
  source 1..2001: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 79 - RNA, 2001 nt, synthetic construct
  misc_feature 1..2001: note = mRNA product Design a-1 comprising derived and/or modified sequence from HRSV(A2)__F0 (opt1)
  source 1..2001: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 80 - RNA, 2001 nt, synthetic construct
  misc_feature 1..2001: note = mRNA product Design a-1 comprising derived and/or modified sequence from HRSV(A2)__F0 (opt1)
  source 1..2001: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 81 - RNA, 2001 nt, synthetic construct
  misc_feature 1..2001: note = mRNA product Design a-1 comprising derived and/or modified sequence from HRSV(A2)__F0 (opt2)
  source 1..2001: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 82 - RNA, 2001 nt, synthetic construct
  misc_feature 1..2001: note = mRNA product Design a-1 comprising derived and/or modified sequence from HRSV(A2)__F0 (opt3)
  source 1..2001: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 83 - RNA, 2001 nt, synthetic construct
  misc_feature 1..2001: note = mRNA product Design a-1 comprising derived and/or modified sequence from HRSV(A2)__F0 (opt4)
  source 1..2001: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 84 - RNA, 2001 nt, synthetic construct
  misc_feature 1..2001: note = mRNA product Design a-1 comprising derived and/or modified sequence from HRSV(A2)__F0 (opt5)
  source 1..2001: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 85 - RNA, 2001 nt, synthetic construct
  misc_feature 1..2001: note = mRNA product Design a-1 comprising derived and/or modified sequence from HRSV(A2)__F0 (opt6)
  source 1..2001: mol_type = other RNA
gggagagtcccgcagtcggcgtccagcggctctgcttgttcgtgtgtgtgtcgttgcaggccttattcaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 86 - RNA, 2001 nt, synthetic construct
  misc_feature 1..2001: note = mRNA product Design a-1 comprising derived and/or modified sequence from HRSV(A2)__F0 (opt11)
  source 1..2001: mol_type = other RNA
gggagagtcccgcagtcggcgtccagcggctctgcttgttcgtgtgtgtgtcgttgcaggccttattcaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 87 - RNA, 2020 nt, synthetic construct
  misc_feature 1..2020: note = mRNA product Design a-2 comprising derived and/or modified sequence from HRSV(A2)__F0 (artificial)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 88 - RNA, 2020 nt, synthetic construct
  misc_feature 1..2020: note = mRNA product Design a-2 comprising derived and/or modified sequence from HRSV(A2)__F0 (opt1)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 89 - RNA, 2020 nt, synthetic construct
  misc_feature 1..2020: note = mRNA product Design a-2 comprising derived and/or modified sequence from HRSV(A2)__F0 (opt1)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 90 - RNA, 2020 nt, synthetic construct
  misc_feature 1..2020: note = mRNA product Design a-2 comprising derived and/or modified sequence from HRSV(A2)__F0 (opt2)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 91 - RNA, 2020 nt, synthetic construct
  misc_feature 1..2020: note = mRNA product Design a-2 comprising derived and/or modified sequence from HRSV(A2)__F0 (opt3)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 92 - RNA, 2020 nt, synthetic construct
  misc_feature 1..2020: note = mRNA product Design a-2 comprising derived and/or modified sequence from HRSV(A2)__F0 (opt4)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 93 - RNA, 2020 nt, synthetic construct
  misc_feature 1..2020: note = mRNA product Design a-2 comprising derived and/or modified sequence from HRSV(A2)__F0 (opt5)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 94 - RNA, 2020 nt, synthetic construct
  misc_feature 1..2020: note = mRNA product Design a-2 comprising derived and/or modified sequence from HRSV(A2)__F0 (opt6)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 95 - RNA, 2020 nt, synthetic construct
  misc_feature 1..2020: note = mRNA product Design a-2 comprising derived and/or modified sequence from HRSV(A2)__F0 (opt11)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 96 - RNA, 2098 nt, synthetic construct
  misc_feature 1..2098: note = mRNA product Design a-3 comprising derived and/or modified sequence from HRSV(A2)__F0 (artificial)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 97 - RNA, 2098 nt, synthetic construct
  misc_feature 1..2098: note = mRNA product Design a-3 comprising derived and/or modified sequence from HRSV(A2)__F0 (opt1)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 98 - RNA, 2098 nt, synthetic construct
  misc_feature 1..2098: note = mRNA product Design a-3 comprising derived and/or modified sequence from HRSV(A2)__F0 (opt1)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 99 - RNA, 2098 nt, synthetic construct
  misc_feature 1..2098: note = mRNA product Design a-3 comprising derived and/or modified sequence from HRSV(A2)__F0 (opt2)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 100 - RNA, 2098 nt, synthetic construct
  misc_feature 1..2098: note = mRNA product Design a-3 comprising derived and/or modified sequence from HRSV(A2)__F0 (opt3)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 101 - RNA, 2098 nt, synthetic construct
  misc_feature 1..2098: note = mRNA product Design a-3 comprising derived and/or modified sequence from HRSV(A2)__F0 (opt4)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 102 - RNA, 2098 nt, synthetic construct
  misc_feature 1..2098: note = mRNA product Design a-3 comprising derived and/or modified sequence from HRSV(A2)__F0 (opt5)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 103 - RNA, 2098 nt, synthetic construct
  misc_feature 1..2098: note = mRNA product Design a-3 comprising derived and/or modified sequence from HRSV(A2)__F0 (opt6)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 104 - RNA, 2098 nt, synthetic construct
  misc_feature 1..2098: note = mRNA product Design a-3 comprising derived and/or modified sequence from HRSV(A2)__F0 (opt11)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 105 - RNA, 2047 nt, synthetic construct
  misc_feature 1..2047: note = mRNA product Design a-4 comprising derived and/or modified sequence from HRSV(A2)__F0 (artificial)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 106 - RNA, 2047 nt, synthetic construct
  misc_feature 1..2047: note = mRNA product Design a-4 comprising derived and/or modified sequence from HRSV(A2)__F0 (opt1)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 107 - RNA, 2047 nt, synthetic construct
  misc_feature 1..2047: note = mRNA product Design a-4 comprising derived and/or modified sequence from HRSV(A2)__F0 (opt1)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 108 - RNA, 2047 nt, synthetic construct
  misc_feature 1..2047: note = mRNA product Design a-4 comprising derived and/or modified sequence from HRSV(A2)__F0 (opt2)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 109 - RNA, 2047 nt, synthetic construct
  misc_feature 1..2047: note = mRNA product Design a-4 comprising derived and/or modified sequence from HRSV(A2)__F0 (opt3)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 110 - RNA, 2047 nt, synthetic construct
  misc_feature 1..2047: note = mRNA product Design a-4 comprising derived and/or modified sequence from HRSV(A2)__F0 (opt4)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 111 - RNA, 2047 nt, synthetic construct
  misc_feature 1..2047: note = mRNA product Design a-4 comprising derived and/or modified sequence from HRSV(A2)__F0 (opt5)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 112 - RNA, 2047 nt, synthetic construct
  misc_feature 1..2047: note = mRNA product Design a-4 comprising derived and/or modified sequence from HRSV(A2)__F0 (opt6)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 113 - RNA, 2047 nt, synthetic construct
  misc_feature 1..2047: note = mRNA product Design a-4 comprising derived and/or modified sequence from HRSV(A2)__F0 (opt11)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 114 - RNA, 1993 nt, synthetic construct
  misc_feature 1..1993: note = mRNA product Design a-5 comprising derived and/or modified sequence from HRSV(A2)__F0 (artificial)
  source 1..1993: mol_type = other RNA
gggagactttcccattctgtagcagaatttggtgttgcctgtggtcttggtcccgcggagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 115 - RNA, 1993 nt, synthetic construct
  misc_feature 1..1993: note = mRNA product Design a-5 comprising derived and/or modified sequence from HRSV(A2)__F0 (opt1)
  source 1..1993: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 116 - RNA, 1993 nt, synthetic construct
  misc_feature 1..1993: note = mRNA product Design a-5 comprising derived and/or modified sequence from HRSV(A2)__F0 (opt1)
  source 1..1993: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 117 - RNA, 1993 nt, synthetic construct
  misc_feature 1..1993: note = mRNA product Design a-5 comprising derived and/or modified sequence from HRSV(A2)__F0 (opt2)
  source 1..1993: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 118 - RNA, 1993 nt, synthetic construct
  misc_feature 1..1993: note = mRNA product Design a-5 comprising derived and/or modified sequence from HRSV(A2)__F0 (opt3)
  source 1..1993: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 119 - RNA, 1993 nt, synthetic construct
  misc_feature 1..1993: note = mRNA product Design a-5 comprising derived and/or modified sequence from HRSV(A2)__F0 (opt4)
  source 1..1993: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 120 - RNA, 1993 nt, synthetic construct
  misc_feature 1..1993: note = mRNA product Design a-5 comprising derived and/or modified sequence from HRSV(A2)__F0 (opt5)
  source 1..1993: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 121 - RNA, 1993 nt, synthetic construct
  misc_feature 1..1993: note = mRNA product Design a-5 comprising derived and/or modified sequence from HRSV(A2)__F0 (opt6)
  source 1..1993: mol_type = other RNA
gggagactttcccattctgtagcagaatttggtgttgcctgtggtcttggtcccgcggagaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 122 - RNA, 1993 nt, synthetic construct
  misc_feature 1..1993: note = mRNA product Design a-5 comprising derived and/or modified sequence from HRSV(A2)__F0 (opt11)
  source 1..1993: mol_type = other RNA
gggagactttcccattctgtagcagaatttggtgttgcctgtggtcttggtcccgcggagaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 123 - RNA, 2174 nt, synthetic construct
  misc_feature 1..2174: note = mRNA product Design b-1 comprising derived and/or modified sequence from HRSV(A2)__F0 (artificial)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 124 - RNA, 2174 nt, synthetic construct
  misc_feature 1..2174: note = mRNA product Design b-1 comprising derived and/or modified sequence from HRSV(A2)__F0 (opt1)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 125 - RNA, 2174 nt, synthetic construct
  misc_feature 1..2174: note = mRNA product Design b-1 comprising derived and/or modified sequence from HRSV(A2)__F0 (opt1)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 126 - RNA, 2174 nt, synthetic construct
  misc_feature 1..2174: note = mRNA product Design b-1 comprising derived and/or modified sequence from HRSV(A2)__F0 (opt2)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 127 - RNA, 2174 nt, synthetic construct
  misc_feature 1..2174: note = mRNA product Design b-1 comprising derived and/or modified sequence from HRSV(A2)__F0 (opt3)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 128 - RNA, 2174 nt, synthetic construct
  misc_feature 1..2174: note = mRNA product Design b-1 comprising derived and/or modified sequence from HRSV(A2)__F0 (opt4)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 129 - RNA, 2174 nt, synthetic construct
  misc_feature 1..2174: note = mRNA product Design b-1 comprising derived and/or modified sequence from HRSV(A2)__F0 (opt5)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 130 - RNA, 2174 nt, synthetic construct
  misc_feature 1..2174: note = mRNA product Design b-1 comprising derived and/or modified sequence from HRSV(A2)__F0 (opt6)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 131 - RNA, 2174 nt, synthetic construct
  misc_feature 1..2174: note = mRNA product Design b-1 comprising derived and/or modified sequence from HRSV(A2)__F0 (opt11)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 132 - RNA, 1994 nt, synthetic construct
  misc_feature 1..1994: note = mRNA product Design b-2 comprising derived and/or modified sequence from HRSV(A2)__F0 (artificial)
  source 1..1994: mol_type = other RNA
gggagagcctctgctggagtccggggagtggcgttggctgctagagcgaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 133 - RNA, 1994 nt, synthetic construct
  misc_feature 1..1994: note = mRNA product Design b-2 comprising derived and/or modified sequence from HRSV(A2)__F0 (opt1)
  source 1..1994: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 134 - RNA, 1994 nt, synthetic construct
  misc_feature 1..1994: note = mRNA product Design b-2 comprising derived and/or modified sequence from HRSV(A2)__F0 (opt1)
  source 1..1994: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 135 - RNA, 1994 nt, synthetic construct
  misc_feature 1..1994: note = mRNA product Design b-2 comprising derived and/or modified sequence from HRSV(A2)__F0 (opt2)
  source 1..1994: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 136 - RNA, 1994 nt, synthetic construct
  misc_feature 1..1994: note = mRNA product Design b-2 comprising derived and/or modified sequence from HRSV(A2)__F0 (opt3)
  source 1..1994: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 137 - RNA, 1994 nt, synthetic construct
  misc_feature 1..1994: note = mRNA product Design b-2 comprising derived and/or modified sequence from HRSV(A2)__F0 (opt4)
  source 1..1994: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 138 - RNA, 1994 nt, synthetic construct
  misc_feature 1..1994: note = mRNA product Design b-2 comprising derived and/or modified sequence from HRSV(A2)__F0 (opt5)
  source 1..1994: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 139 - RNA, 1994 nt, synthetic construct
  misc_feature 1..1994: note = mRNA product Design b-2 comprising derived and/or modified sequence from HRSV(A2)__F0 (opt6)
  source 1..1994: mol_type = other RNA
gggagagcctctgctggagtccggggagtggcgttggctgctagagcgaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 140 - RNA, 1994 nt, synthetic construct
  misc_feature 1..1994: note = mRNA product Design b-2 comprising derived and/or modified sequence from HRSV(A2)__F0 (opt11)
  source 1..1994: mol_type = other RNA
gggagagcctctgctggagtccggggagtggcgttggctgctagagcgaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 141 - RNA, 2014 nt, synthetic construct
  misc_feature 1..2014: note = mRNA product Design b-3 comprising derived and/or modified sequence from HRSV(A2)__F0 (artificial)
  source 1..2014: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 142 - RNA, 2014 nt, synthetic construct
  misc_feature 1..2014: note = mRNA product Design b-3 comprising derived and/or modified sequence from HRSV(A2)__F0 (opt1)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 143 - RNA, 2014 nt, synthetic construct
  misc_feature 1..2014: note = mRNA product Design b-3 comprising derived and/or modified sequence from HRSV(A2)__F0 (opt1)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 144 - RNA, 2014 nt, synthetic construct
  misc_feature 1..2014: note = mRNA product Design b-3 comprising derived and/or modified sequence from HRSV(A2)__F0 (opt2)
  source 1..2014: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 145 - RNA, 2014 nt, synthetic construct
  misc_feature 1..2014: note = mRNA product Design b-3 comprising derived and/or modified sequence from HRSV(A2)__F0 (opt3)
  source 1..2014: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 146 - RNA, 2014 nt, synthetic construct
  misc_feature 1..2014: note = mRNA product Design b-3 comprising derived and/or modified sequence from HRSV(A2)__F0 (opt4)
  source 1..2014: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 147 - RNA, 2014 nt, synthetic construct
  misc_feature 1..2014: note = mRNA product Design b-3 comprising derived and/or modified sequence from HRSV(A2)__F0 (opt5)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 148 - RNA, 2014 nt, synthetic construct
  misc_feature 1..2014: note = mRNA product Design b-3 comprising derived and/or modified sequence from HRSV(A2)__F0 (opt6)
  source 1..2014: mol_type = other RNA
gggagagtcccgcagtcggcgtccagcggctctgcttgttcgtgtgtgtgtcgttgcaggccttattcaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 149 - RNA, 2014 nt, synthetic construct
  misc_feature 1..2014: note = mRNA product Design b-3 comprising derived and/or modified sequence from HRSV(A2)__F0 (opt11)
  source 1..2014: mol_type = other RNA
gggagagtcccgcagtcggcgtccagcggctctgcttgttcgtgtgtgtgtcgttgcaggccttattcaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 150 - RNA, 2065 nt, synthetic construct
  misc_feature 1..2065: note = mRNA product Design b-4 comprising derived and/or modified sequence from HRSV(A2)__F0 (artificial)
  source 1..2065: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 151 - RNA, 2065 nt, synthetic construct
  misc_feature 1..2065: note = mRNA product Design b-4 comprising derived and/or modified sequence from HRSV(A2)__F0 (opt1)
  source 1..2065: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 152 - RNA, 2065 nt, synthetic construct
  misc_feature 1..2065: note = mRNA product Design b-4 comprising derived and/or modified sequence from HRSV(A2)__F0 (opt1)
  source 1..2065: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 153 - RNA, 2065 nt, synthetic construct
  misc_feature 1..2065: note = mRNA product Design b-4 comprising derived and/or modified sequence from HRSV(A2)__F0 (opt2)
  source 1..2065: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 154 - RNA, 2065 nt, synthetic construct
  misc_feature 1..2065: note = mRNA product Design b-4 comprising derived and/or modified sequence from HRSV(A2)__F0 (opt3)
  source 1..2065: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 155 - RNA, 2065 nt, synthetic construct
  misc_feature 1..2065: note = mRNA product Design b-4 comprising derived and/or modified sequence from HRSV(A2)__F0 (opt4)
  source 1..2065: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 156 - RNA, 2065 nt, synthetic construct
  misc_feature 1..2065: note = mRNA product Design b-4 comprising derived and/or modified sequence from HRSV(A2)__F0 (opt5)
  source 1..2065: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 157 - RNA, 2065 nt, synthetic construct
  misc_feature 1..2065: note = mRNA product Design b-4 comprising derived and/or modified sequence from HRSV(A2)__F0 (opt6)
  source 1..2065: mol_type = other RNA
gggagagtcccgcagtcggcgtccagcggctctgcttgttcgtgtgtgtgtcgttgcaggccttattcaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 158 - RNA, 2065 nt, synthetic construct
  misc_feature 1..2065: note = mRNA product Design b-4 comprising derived and/or modified sequence from HRSV(A2)__F0 (opt11)
  source 1..2065: mol_type = other RNA
gggagagtcccgcagtcggcgtccagcggctctgcttgttcgtgtgtgtgtcgttgcaggccttattcaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 159 - RNA, 2127 nt, synthetic construct
  misc_feature 1..2127: note = mRNA product Design b-5 comprising derived and/or modified sequence from HRSV(A2)__F0 (artificial)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 160 - RNA, 2127 nt, synthetic construct
  misc_feature 1..2127: note = mRNA product Design b-5 comprising derived and/or modified sequence from HRSV(A2)__F0 (opt1)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 161 - RNA, 2127 nt, synthetic construct
  misc_feature 1..2127: note = mRNA product Design b-5 comprising derived and/or modified sequence from HRSV(A2)__F0 (opt1)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 162 - RNA, 2127 nt, synthetic construct
  misc_feature 1..2127: note = mRNA product Design b-5 comprising derived and/or modified sequence from HRSV(A2)__F0 (opt2)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 163 - RNA, 2127 nt, synthetic construct
  misc_feature 1..2127: note = mRNA product Design b-5 comprising derived and/or modified sequence from HRSV(A2)__F0 (opt3)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 164 - RNA, 2127 nt, synthetic construct
  misc_feature 1..2127: note = mRNA product Design b-5 comprising derived and/or modified sequence from HRSV(A2)__F0 (opt4)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 165 - RNA, 2127 nt, synthetic construct
  misc_feature 1..2127: note = mRNA product Design b-5 comprising derived and/or modified sequence from HRSV(A2)__F0 (opt5)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 166 - RNA, 2127 nt, synthetic construct
  misc_feature 1..2127: note = mRNA product Design b-5 comprising derived and/or modified sequence from HRSV(A2)__F0 (opt6)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 167 - RNA, 2127 nt, synthetic construct
  misc_feature 1..2127: note = mRNA product Design b-5 comprising derived and/or modified sequence from HRSV(A2)__F0 (opt11)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 168 - RNA, 2033 nt, synthetic construct
  misc_feature 1..2033: note = mRNA product Design c-1 comprising derived and/or modified sequence from HRSV(A2)__F0 (artificial)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 169 - RNA, 2033 nt, synthetic construct
  misc_feature 1..2033: note = mRNA product Design c-1 comprising derived and/or modified sequence from HRSV(A2)__F0 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 170 - RNA, 2033 nt, synthetic construct
  misc_feature 1..2033: note = mRNA product Design c-1 comprising derived and/or modified sequence from HRSV(A2)__F0 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 171 - RNA, 2033 nt, synthetic construct
  misc_feature 1..2033: note = mRNA product Design c-1 comprising derived and/or modified sequence from HRSV(A2)__F0 (opt2)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 172 - RNA, 2033 nt, synthetic construct
  misc_feature 1..2033: note = mRNA product Design c-1 comprising derived and/or modified sequence from HRSV(A2)__F0 (opt3)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 173 - RNA, 2033 nt, synthetic construct
  misc_feature 1..2033: note = mRNA product Design c-1 comprising derived and/or modified sequence from HRSV(A2)__F0 (opt4)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 174 - RNA, 2033 nt, synthetic construct
  misc_feature 1..2033: note = mRNA product Design c-1 comprising derived and/or modified sequence from HRSV(A2)__F0 (opt5)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 175 - RNA, 2033 nt, synthetic construct
  misc_feature 1..2033: note = mRNA product Design c-1 comprising derived and/or modified sequence from HRSV(A2)__F0 (opt6)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 176 - RNA, 2033 nt, synthetic construct
  misc_feature 1..2033: note = mRNA product Design c-1 comprising derived and/or modified sequence from HRSV(A2)__F0 (opt11)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 177 - RNA, 2123 nt, synthetic construct
  misc_feature 1..2123: note = mRNA product Design c-2 comprising derived and/or modified sequence from HRSV(A2)__F0 (artificial)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 178 - RNA, 2123 nt, synthetic construct
  misc_feature 1..2123: note = mRNA product Design c-2 comprising derived and/or modified sequence from HRSV(A2)__F0 (opt1)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 179 - RNA, 2123 nt, synthetic construct
  misc_feature 1..2123: note = mRNA product Design c-2 comprising derived and/or modified sequence from HRSV(A2)__F0 (opt1)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 180 - RNA, 2123 nt, synthetic construct
  misc_feature 1..2123: note = mRNA product Design c-2 comprising derived and/or modified sequence from HRSV(A2)__F0 (opt2)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 181 - RNA, 2123 nt, synthetic construct
  misc_feature 1..2123: note = mRNA product Design c-2 comprising derived and/or modified sequence from HRSV(A2)__F0 (opt3)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 182 - RNA, 2123 nt, synthetic construct
  misc_feature 1..2123: note = mRNA product Design c-2 comprising derived and/or modified sequence from HRSV(A2)__F0 (opt4)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 183 - RNA, 2123 nt, synthetic construct
  misc_feature 1..2123: note = mRNA product Design c-2 comprising derived and/or modified sequence from HRSV(A2)__F0 (opt5)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 184 - RNA, 2123 nt, synthetic construct
  misc_feature 1..2123: note = mRNA product Design c-2 comprising derived and/or modified sequence from HRSV(A2)__F0 (opt6)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 185 - RNA, 2123 nt, synthetic construct
  misc_feature 1..2123: note = mRNA product Design c-2 comprising derived and/or modified sequence from HRSV(A2)__F0 (opt11)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 186 - RNA, 2100 nt, synthetic construct
  misc_feature 1..2100: note = mRNA product Design c-3 comprising derived and/or modified sequence from HRSV(A2)__F0 (artificial)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 187 - RNA, 2100 nt, synthetic construct
  misc_feature 1..2100: note = mRNA product Design c-3 comprising derived and/or modified sequence from HRSV(A2)__F0 (opt1)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 188 - RNA, 2100 nt, synthetic construct
  misc_feature 1..2100: note = mRNA product Design c-3 comprising derived and/or modified sequence from HRSV(A2)__F0 (opt1)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 189 - RNA, 2100 nt, synthetic construct
  misc_feature 1..2100: note = mRNA product Design c-3 comprising derived and/or modified sequence from HRSV(A2)__F0 (opt2)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 190 - RNA, 2100 nt, synthetic construct
  misc_feature 1..2100: note = mRNA product Design c-3 comprising derived and/or modified sequence from HRSV(A2)__F0 (opt3)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 191 - RNA, 2100 nt, synthetic construct
  misc_feature 1..2100: note = mRNA product Design c-3 comprising derived and/or modified sequence from HRSV(A2)__F0 (opt4)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 192 - RNA, 2100 nt, synthetic construct
  misc_feature 1..2100: note = mRNA product Design c-3 comprising derived and/or modified sequence from HRSV(A2)__F0 (opt5)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 193 - RNA, 2100 nt, synthetic construct
  misc_feature 1..2100: note = mRNA product Design c-3 comprising derived and/or modified sequence from HRSV(A2)__F0 (opt6)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 194 - RNA, 2100 nt, synthetic construct
  misc_feature 1..2100: note = mRNA product Design c-3 comprising derived and/or modified sequence from HRSV(A2)__F0 (opt11)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 195 - RNA, 2096 nt, synthetic construct
  misc_feature 1..2096: note = mRNA product Design c-4 comprising derived and/or modified sequence from HRSV(A2)__F0 (artificial)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 196 - RNA, 2096 nt, synthetic construct
  misc_feature 1..2096: note = mRNA product Design c-4 comprising derived and/or modified sequence from HRSV(A2)__F0 (opt1)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 197 - RNA, 2096 nt, synthetic construct
  misc_feature 1..2096: note = mRNA product Design c-4 comprising derived and/or modified sequence from HRSV(A2)__F0 (opt1)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 198 - RNA, 2096 nt, synthetic construct
  misc_feature 1..2096: note = mRNA product Design c-4 comprising derived and/or modified sequence from HRSV(A2)__F0 (opt2)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 199 - RNA, 2096 nt, synthetic construct
  misc_feature 1..2096: note = mRNA product Design c-4 comprising derived and/or modified sequence from HRSV(A2)__F0 (opt3)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 200 - RNA, 2096 nt, synthetic construct
  misc_feature 1..2096: note = mRNA product Design c-4 comprising derived and/or modified sequence from HRSV(A2)__F0 (opt4)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 201 - RNA, 2096 nt, synthetic construct
  misc_feature 1..2096: note = mRNA product Design c-4 comprising derived and/or modified sequence from HRSV(A2)__F0 (opt5)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 202 - RNA, 2096 nt, synthetic construct
  misc_feature 1..2096: note = mRNA product Design c-4 comprising derived and/or modified sequence from HRSV(A2)__F0 (opt6)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 203 - RNA, 2096 nt, synthetic construct
  misc_feature 1..2096: note = mRNA product Design c-4 comprising derived and/or modified sequence from HRSV(A2)__F0 (opt11)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 204 - RNA, 2014 nt, synthetic construct
  misc_feature 1..2014: note = mRNA product Design c-5 comprising derived and/or modified sequence from HRSV(A2)__F0 (artificial)
  source 1..2014: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 205 - RNA, 2014 nt, synthetic construct
  misc_feature 1..2014: note = mRNA product Design c-5 comprising derived and/or modified sequence from HRSV(A2)__F0 (opt1)
  source 1..2014: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 206 - RNA, 2014 nt, synthetic construct
  misc_feature 1..2014: note = mRNA product Design c-5 comprising derived and/or modified sequence from HRSV(A2)__F0 (opt1)
  source 1..2014: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 207 - RNA, 2014 nt, synthetic construct
  misc_feature 1..2014: note = mRNA product Design c-5 comprising derived and/or modified sequence from HRSV(A2)__F0 (opt2)
  source 1..2014: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 208 - RNA, 2014 nt, synthetic construct
  misc_feature 1..2014: note = mRNA product Design c-5 comprising derived and/or modified sequence from HRSV(A2)__F0 (opt3)
  source 1..2014: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 209 - RNA, 2014 nt, synthetic construct
  misc_feature 1..2014: note = mRNA product Design c-5 comprising derived and/or modified sequence from HRSV(A2)__F0 (opt4)
  source 1..2014: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 210 - RNA, 2014 nt, synthetic construct
  misc_feature 1..2014: note = mRNA product Design c-5 comprising derived and/or modified sequence from HRSV(A2)__F0 (opt5)
  source 1..2014: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 211 - RNA, 2014 nt, synthetic construct
  misc_feature 1..2014: note = mRNA product Design c-5 comprising derived and/or modified sequence from HRSV(A2)__F0 (opt6)
  source 1..2014: mol_type = other RNA
gggagagcggctcggccattttgtcccagtcagtccggaggctgcggctgcagaagtaccgcctgcggagtaactgcaaagaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 212 - RNA, 2014 nt, synthetic construct
  misc_feature 1..2014: note = mRNA product Design c-5 comprising derived and/or modified sequence from HRSV(A2)__F0 (opt11)
  source 1..2014: mol_type = other RNA
gggagagcggctcggccattttgtcccagtcagtccggaggctgcggctgcagaagtaccgcctgcggagtaactgcaaagaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 213 - RNA, 2023 nt, synthetic construct
  misc_feature 1..2023: note = mRNA product Design d-1 comprising derived and/or modified sequence from HRSV(A2)__F0 (artificial)
  source 1..2023: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 214 - RNA, 2023 nt, synthetic construct
  misc_feature 1..2023: note = mRNA product Design d-1 comprising derived and/or modified sequence from HRSV(A2)__F0 (opt1)
  source 1..2023: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 215 - RNA, 2023 nt, synthetic construct
  misc_feature 1..2023: note = mRNA product Design d-1 comprising derived and/or modified sequence from HRSV(A2)__F0 (opt1)
  source 1..2023: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 216 - RNA, 2023 nt, synthetic construct
  misc_feature 1..2023: note = mRNA product Design d-1 comprising derived and/or modified sequence from HRSV(A2)__F0 (opt2)
  source 1..2023: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 217 - RNA, 2023 nt, synthetic construct
  misc_feature 1..2023: note = mRNA product Design d-1 comprising derived and/or modified sequence from HRSV(A2)__F0 (opt3)
  source 1..2023: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 218 - RNA, 2023 nt, synthetic construct
  misc_feature 1..2023: note = mRNA product Design d-1 comprising derived and/or modified sequence from HRSV(A2)__F0 (opt4)
  source 1..2023: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 219 - RNA, 2023 nt, synthetic construct
  misc_feature 1..2023: note = mRNA product Design d-1 comprising derived and/or modified sequence from HRSV(A2)__F0 (opt5)
  source 1..2023: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 220 - RNA, 2023 nt, synthetic construct
  misc_feature 1..2023: note = mRNA product Design d-1 comprising derived and/or modified sequence from HRSV(A2)__F0 (opt6)
  source 1..2023: mol_type = other RNA
gggagacccgtgacccggaagttgtacggctacgcgactttccctcccacaaaccctcgcgcccttcctttcctacttgggcccggcagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 221 - RNA, 2023 nt, synthetic construct
  misc_feature 1..2023: note = mRNA product Design d-1 comprising derived and/or modified sequence from HRSV(A2)__F0 (opt11)
  source 1..2023: mol_type = other RNA
gggagacccgtgacccggaagttgtacggctacgcgactttccctcccacaaaccctcgcgcccttcctttcctacttgggcccggcagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 222 - RNA, 2078 nt, synthetic construct
  misc_feature 1..2078: note = mRNA product Design d-2 comprising derived and/or modified sequence from HRSV(A2)__F0 (artificial)
  source 1..2078: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 223 - RNA, 2078 nt, synthetic construct
  misc_feature 1..2078: note = mRNA product Design d-2 comprising derived and/or modified sequence from HRSV(A2)__F0 (opt1)
  source 1..2078: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 224 - RNA, 2078 nt, synthetic construct
  misc_feature 1..2078: note = mRNA product Design d-2 comprising derived and/or modified sequence from HRSV(A2)__F0 (opt1)
  source 1..2078: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 225 - RNA, 2078 nt, synthetic construct
  misc_feature 1..2078: note = mRNA product Design d-2 comprising derived and/or modified sequence from HRSV(A2)__F0 (opt2)
  source 1..2078: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 226 - RNA, 2078 nt, synthetic construct
  misc_feature 1..2078: note = mRNA product Design d-2 comprising derived and/or modified sequence from HRSV(A2)__F0 (opt3)
  source 1..2078: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 227 - RNA, 2078 nt, synthetic construct
  misc_feature 1..2078: note = mRNA product Design d-2 comprising derived and/or modified sequence from HRSV(A2)__F0 (opt4)
  source 1..2078: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 228 - RNA, 2078 nt, synthetic construct
  misc_feature 1..2078: note = mRNA product Design d-2 comprising derived and/or modified sequence from HRSV(A2)__F0 (opt5)
  source 1..2078: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 229 - RNA, 2078 nt, synthetic construct
  misc_feature 1..2078: note = mRNA product Design d-2 comprising derived and/or modified sequence from HRSV(A2)__F0 (opt6)
  source 1..2078: mol_type = other RNA
gggagagcggctcggccattttgtcccagtcagtccggaggctgcggctgcagaagtaccgcctgcggagtaactgcaaagaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 230 - RNA, 2078 nt, synthetic construct
  misc_feature 1..2078: note = mRNA product Design d-2 comprising derived and/or modified sequence from HRSV(A2)__F0 (opt11)
  source 1..2078: mol_type = other RNA
gggagagcggctcggccattttgtcccagtcagtccggaggctgcggctgcagaagtaccgcctgcggagtaactgcaaagaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 231 - RNA, 2394 nt, synthetic construct
  misc_feature 1..2394: note = mRNA product Design d-3 comprising derived and/or modified sequence from HRSV(A2)__F0 (artificial)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 232 - RNA, 2394 nt, synthetic construct
  misc_feature 1..2394: note = mRNA product Design d-3 comprising derived and/or modified sequence from HRSV(A2)__F0 (opt1)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 233 - RNA, 2394 nt, synthetic construct
  misc_feature 1..2394: note = mRNA product Design d-3 comprising derived and/or modified sequence from HRSV(A2)__F0 (opt1)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 234 - RNA, 2394 nt, synthetic construct
  misc_feature 1..2394: note = mRNA product Design d-3 comprising derived and/or modified sequence from HRSV(A2)__F0 (opt2)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 235 - RNA, 2394 nt, synthetic construct
  misc_feature 1..2394: note = mRNA product Design d-3 comprising derived and/or modified sequence from HRSV(A2)__F0 (opt3)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 236 - RNA, 2394 nt, synthetic construct
  misc_feature 1..2394: note = mRNA product Design d-3 comprising derived and/or modified sequence from HRSV(A2)__F0 (opt4)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 237 - RNA, 2394 nt, synthetic construct
  misc_feature 1..2394: note = mRNA product Design d-3 comprising derived and/or modified sequence from HRSV(A2)__F0 (opt5)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 238 - RNA, 2394 nt, synthetic construct
  misc_feature 1..2394: note = mRNA product Design d-3 comprising derived and/or modified sequence from HRSV(A2)__F0 (opt6)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 239 - RNA, 2394 nt, synthetic construct
  misc_feature 1..2394: note = mRNA product Design d-3 comprising derived and/or modified sequence from HRSV(A2)__F0 (opt11)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 240 - RNA, 2077 nt, synthetic construct
  misc_feature 1..2077: note = mRNA product Design d-4 comprising derived and/or modified sequence from HRSV(A2)__F0 (artificial)
  source 1..2077: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 241 - RNA, 2077 nt, synthetic construct
  misc_feature 1..2077: note = mRNA product Design d-4 comprising derived and/or modified sequence from HRSV(A2)__F0 (opt1)
  source 1..2077: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 242 - RNA, 2077 nt, synthetic construct
  misc_feature 1..2077: note = mRNA product Design d-4 comprising derived and/or modified sequence from HRSV(A2)__F0 (opt1)
  source 1..2077: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 243 - RNA, 2077 nt, synthetic construct
  misc_feature 1..2077: note = mRNA product Design d-4 comprising derived and/or modified sequence from HRSV(A2)__F0 (opt2)
  source 1..2077: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 244 - RNA, 2077 nt, synthetic construct
  misc_feature 1..2077: note = mRNA product Design d-4 comprising derived and/or modified sequence from HRSV(A2)__F0 (opt3)
  source 1..2077: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 245 - RNA, 2077 nt, synthetic construct
  misc_feature 1..2077: note = mRNA product Design d-4 comprising derived and/or modified sequence from HRSV(A2)__F0 (opt4)
  source 1..2077: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 246 - RNA, 2077 nt, synthetic construct
  misc_feature 1..2077: note = mRNA product Design d-4 comprising derived and/or modified sequence from HRSV(A2)__F0 (opt5)
  source 1..2077: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 247 - RNA, 2077 nt, synthetic construct
  misc_feature 1..2077: note = mRNA product Design d-4 comprising derived and/or modified sequence from HRSV(A2)__F0 (opt6)
  source 1..2077: mol_type = other RNA
gggagagtcccgcagtcggcgtccagcggctctgcttgttcgtgtgtgtgtcgttgcaggccttattcaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 248 - RNA, 2077 nt, synthetic construct
  misc_feature 1..2077: note = mRNA product Design d-4 comprising derived and/or modified sequence from HRSV(A2)__F0 (opt11)
  source 1..2077: mol_type = other RNA
gggagagtcccgcagtcggcgtccagcggctctgcttgttcgtgtgtgtgtcgttgcaggccttattcaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 249 - RNA, 2174 nt, synthetic construct
  misc_feature 1..2174: note = mRNA product Design d-5 comprising derived and/or modified sequence from HRSV(A2)__F0 (artificial)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 250 - RNA, 2174 nt, synthetic construct
  misc_feature 1..2174: note = mRNA product Design d-5 comprising derived and/or modified sequence from HRSV(A2)__F0 (opt1)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 251 - RNA, 2174 nt, synthetic construct
  misc_feature 1..2174: note = mRNA product Design d-5 comprising derived and/or modified sequence from HRSV(A2)__F0 (opt1)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 252 - RNA, 2174 nt, synthetic construct
  misc_feature 1..2174: note = mRNA product Design d-5 comprising derived and/or modified sequence from HRSV(A2)__F0 (opt2)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 253 - RNA, 2174 nt, synthetic construct
  misc_feature 1..2174: note = mRNA product Design d-5 comprising derived and/or modified sequence from HRSV(A2)__F0 (opt3)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 254 - RNA, 2174 nt, synthetic construct
  misc_feature 1..2174: note = mRNA product Design d-5 comprising derived and/or modified sequence from HRSV(A2)__F0 (opt4)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 255 - RNA, 2174 nt, synthetic construct
  misc_feature 1..2174: note = mRNA product Design d-5 comprising derived and/or modified sequence from HRSV(A2)__F0 (opt5)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 256 - RNA, 2174 nt, synthetic construct
  misc_feature 1..2174: note = mRNA product Design d-5 comprising derived and/or modified sequence from HRSV(A2)__F0 (opt6)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 257 - RNA, 2174 nt, synthetic construct
  misc_feature 1..2174: note = mRNA product Design d-5 comprising derived and/or modified sequence from HRSV(A2)__F0 (opt11)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 258 - RNA, 2054 nt, synthetic construct
  misc_feature 1..2054: note = mRNA product Design e-1 comprising derived and/or modified sequence from HRSV(A2)__F0 (artificial)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 259 - RNA, 2054 nt, synthetic construct
  misc_feature 1..2054: note = mRNA product Design e-1 comprising derived and/or modified sequence from HRSV(A2)__F0 (opt1)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 260 - RNA, 2054 nt, synthetic construct
  misc_feature 1..2054: note = mRNA product Design e-1 comprising derived and/or modified sequence from HRSV(A2)__F0 (opt1)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 261 - RNA, 2054 nt, synthetic construct
  misc_feature 1..2054: note = mRNA product Design e-1 comprising derived and/or modified sequence from HRSV(A2)__F0 (opt2)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 262 - RNA, 2054 nt, synthetic construct
  misc_feature 1..2054: note = mRNA product Design e-1 comprising derived and/or modified sequence from HRSV(A2)__F0 (opt3)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 263 - RNA, 2054 nt, synthetic construct
  misc_feature 1..2054: note = mRNA product Design e-1 comprising derived and/or modified sequence from HRSV(A2)__F0 (opt4)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 264 - RNA, 2054 nt, synthetic construct
  misc_feature 1..2054: note = mRNA product Design e-1 comprising derived and/or modified sequence from HRSV(A2)__F0 (opt5)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 265 - RNA, 2054 nt, synthetic construct
  misc_feature 1..2054: note = mRNA product Design e-1 comprising derived and/or modified sequence from HRSV(A2)__F0 (opt6)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 266 - RNA, 2054 nt, synthetic construct
  misc_feature 1..2054: note = mRNA product Design e-1 comprising derived and/or modified sequence from HRSV(A2)__F0 (opt11)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 267 - RNA, 2036 nt, synthetic construct
  misc_feature 1..2036: note = mRNA product Design e-2 comprising derived and/or modified sequence from HRSV(A2)__F0 (artificial)
  source 1..2036: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 268 - RNA, 2036 nt, synthetic construct
  misc_feature 1..2036: note = mRNA product Design e-2 comprising derived and/or modified sequence from HRSV(A2)__F0 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 269 - RNA, 2036 nt, synthetic construct
  misc_feature 1..2036: note = mRNA product Design e-2 comprising derived and/or modified sequence from HRSV(A2)__F0 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 270 - RNA, 2036 nt, synthetic construct
  misc_feature 1..2036: note = mRNA product Design e-2 comprising derived and/or modified sequence from HRSV(A2)__F0 (opt2)
  source 1..2036: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 271 - RNA, 2036 nt, synthetic construct
  misc_feature 1..2036: note = mRNA product Design e-2 comprising derived and/or modified sequence from HRSV(A2)__F0 (opt3)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 272 - RNA, 2036 nt, synthetic construct
  misc_feature 1..2036: note = mRNA product Design e-2 comprising derived and/or modified sequence from HRSV(A2)__F0 (opt4)
  source 1..2036: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 273 - RNA, 2036 nt, synthetic construct
  misc_feature 1..2036: note = mRNA product Design e-2 comprising derived and/or modified sequence from HRSV(A2)__F0 (opt5)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 274 - RNA, 2036 nt, synthetic construct
  misc_feature 1..2036: note = mRNA product Design e-2 comprising derived and/or modified sequence from HRSV(A2)__F0 (opt6)
  source 1..2036: mol_type = other RNA
gggagacccgtgacccggaagttgtacggctacgcgactttccctcccacaaaccctcgcgcccttcctttcctacttgggcccggcagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 275 - RNA, 2036 nt, synthetic construct
  misc_feature 1..2036: note = mRNA product Design e-2 comprising derived and/or modified sequence from HRSV(A2)__F0 (opt11)
  source 1..2036: mol_type = other RNA
gggagacccgtgacccggaagttgtacggctacgcgactttccctcccacaaaccctcgcgcccttcctttcctacttgggcccggcagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 276 - RNA, 2006 nt, synthetic construct
  misc_feature 1..2006: note = mRNA product Design e-3 comprising derived and/or modified sequence from HRSV(A2)__F0 (artificial)
  source 1..2006: mol_type = other RNA
gggagactttcccattctgtagcagaatttggtgttgcctgtggtcttggtcccgcggagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 277 - RNA, 2006 nt, synthetic construct
  misc_feature 1..2006: note = mRNA product Design e-3 comprising derived and/or modified sequence from HRSV(A2)__F0 (opt1)
  source 1..2006: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 278 - RNA, 2006 nt, synthetic construct
  misc_feature 1..2006: note = mRNA product Design e-3 comprising derived and/or modified sequence from HRSV(A2)__F0 (opt1)
  source 1..2006: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 279 - RNA, 2006 nt, synthetic construct
  misc_feature 1..2006: note = mRNA product Design e-3 comprising derived and/or modified sequence from HRSV(A2)__F0 (opt2)
  source 1..2006: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 280 - RNA, 2006 nt, synthetic construct
  misc_feature 1..2006: note = mRNA product Design e-3 comprising derived and/or modified sequence from HRSV(A2)__F0 (opt3)
  source 1..2006: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 281 - RNA, 2006 nt, synthetic construct
  misc_feature 1..2006: note = mRNA product Design e-3 comprising derived and/or modified sequence from HRSV(A2)__F0 (opt4)
  source 1..2006: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 282 - RNA, 2006 nt, synthetic construct
  misc_feature 1..2006: note = mRNA product Design e-3 comprising derived and/or modified sequence from HRSV(A2)__F0 (opt5)
  source 1..2006: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 283 - RNA, 2006 nt, synthetic construct
  misc_feature 1..2006: note = mRNA product Design e-3 comprising derived and/or modified sequence from HRSV(A2)__F0 (opt6)
  source 1..2006: mol_type = other RNA
gggagactttcccattctgtagcagaatttggtgttgcctgtggtcttggtcccgcggagaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 284 - RNA, 2006 nt, synthetic construct
  misc_feature 1..2006: note = mRNA product Design e-3 comprising derived and/or modified sequence from HRSV(A2)__F0 (opt11)
  source 1..2006: mol_type = other RNA
gggagactttcccattctgtagcagaatttggtgttgcctgtggtcttggtcccgcggagaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 285 - RNA, 2060 nt, synthetic construct
  misc_feature 1..2060: note = mRNA product Design e-4 comprising derived and/or modified sequence from HRSV(A2)__F0 (artificial)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 286 - RNA, 2060 nt, synthetic construct
  misc_feature 1..2060: note = mRNA product Design e-4 comprising derived and/or modified sequence from HRSV(A2)__F0 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 287 - RNA, 2060 nt, synthetic construct
  misc_feature 1..2060: note = mRNA product Design e-4 comprising derived and/or modified sequence from HRSV(A2)__F0 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 288 - RNA, 2060 nt, synthetic construct
  misc_feature 1..2060: note = mRNA product Design e-4 comprising derived and/or modified sequence from HRSV(A2)__F0 (opt2)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 289 - RNA, 2060 nt, synthetic construct
  misc_feature 1..2060: note = mRNA product Design e-4 comprising derived and/or modified sequence from HRSV(A2)__F0 (opt3)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 290 - RNA, 2060 nt, synthetic construct
  misc_feature 1..2060: note = mRNA product Design e-4 comprising derived and/or modified sequence from HRSV(A2)__F0 (opt4)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 291 - RNA, 2060 nt, synthetic construct
  misc_feature 1..2060: note = mRNA product Design e-4 comprising derived and/or modified sequence from HRSV(A2)__F0 (opt5)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 292 - RNA, 2060 nt, synthetic construct
  misc_feature 1..2060: note = mRNA product Design e-4 comprising derived and/or modified sequence from HRSV(A2)__F0 (opt6)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 293 - RNA, 2060 nt, synthetic construct
  misc_feature 1..2060: note = mRNA product Design e-4 comprising derived and/or modified sequence from HRSV(A2)__F0 (opt11)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 294 - RNA, 2027 nt, synthetic construct
  misc_feature 1..2027: note = mRNA product Design e-5 comprising derived and/or modified sequence from HRSV(A2)__F0 (artificial)
  source 1..2027: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 295 - RNA, 2027 nt, synthetic construct
  misc_feature 1..2027: note = mRNA product Design e-5 comprising derived and/or modified sequence from HRSV(A2)__F0 (opt1)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 296 - RNA, 2027 nt, synthetic construct
  misc_feature 1..2027: note = mRNA product Design e-5 comprising derived and/or modified sequence from HRSV(A2)__F0 (opt1)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 297 - RNA, 2027 nt, synthetic construct
  misc_feature 1..2027: note = mRNA product Design e-5 comprising derived and/or modified sequence from HRSV(A2)__F0 (opt2)
  source 1..2027: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 298 - RNA, 2027 nt, synthetic construct
  misc_feature 1..2027: note = mRNA product Design e-5 comprising derived and/or modified sequence from HRSV(A2)__F0 (opt3)
  source 1..2027: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 299 - RNA, 2027 nt, synthetic construct
  misc_feature 1..2027: note = mRNA product Design e-5 comprising derived and/or modified sequence from HRSV(A2)__F0 (opt4)
  source 1..2027: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 300 - RNA, 2027 nt, synthetic construct
  misc_feature 1..2027: note = mRNA product Design e-5 comprising derived and/or modified sequence from HRSV(A2)__F0 (opt5)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 301 - RNA, 2027 nt, synthetic construct
  misc_feature 1..2027: note = mRNA product Design e-5 comprising derived and/or modified sequence from HRSV(A2)__F0 (opt6)
  source 1..2027: mol_type = other RNA
gggagagcggctcggccattttgtcccagtcagtccggaggctgcggctgcagaagtaccgcctgcggagtaactgcaaagaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 302 - RNA, 2027 nt, synthetic construct
  misc_feature 1..2027: note = mRNA product Design e-5 comprising derived and/or modified sequence from HRSV(A2)__F0 (opt11)
  source 1..2027: mol_type = other RNA
gggagagcggctcggccattttgtcccagtcagtccggaggctgcggctgcagaagtaccgcctgcggagtaactgcaaagaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 303 - RNA, 2094 nt, synthetic construct
  misc_feature 1..2094: note = mRNA product Design e-6 comprising derived and/or modified sequence from HRSV(A2)__F0 (artificial)
  source 1..2094: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 304 - RNA, 2094 nt, synthetic construct
  misc_feature 1..2094: note = mRNA product Design e-6 comprising derived and/or modified sequence from HRSV(A2)__F0 (opt1)
  source 1..2094: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 305 - RNA, 2094 nt, synthetic construct
  misc_feature 1..2094: note = mRNA product Design e-6 comprising derived and/or modified sequence from HRSV(A2)__F0 (opt1)
  source 1..2094: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 306 - RNA, 2094 nt, synthetic construct
  misc_feature 1..2094: note = mRNA product Design e-6 comprising derived and/or modified sequence from HRSV(A2)__F0 (opt2)
  source 1..2094: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 307 - RNA, 2094 nt, synthetic construct
  misc_feature 1..2094: note = mRNA product Design e-6 comprising derived and/or modified sequence from HRSV(A2)__F0 (opt3)
  source 1..2094: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 308 - RNA, 2094 nt, synthetic construct
  misc_feature 1..2094: note = mRNA product Design e-6 comprising derived and/or modified sequence from HRSV(A2)__F0 (opt4)
  source 1..2094: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 309 - RNA, 2094 nt, synthetic construct
  misc_feature 1..2094: note = mRNA product Design e-6 comprising derived and/or modified sequence from HRSV(A2)__F0 (opt5)
  source 1..2094: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 310 - RNA, 2094 nt, synthetic construct
  misc_feature 1..2094: note = mRNA product Design e-6 comprising derived and/or modified sequence from HRSV(A2)__F0 (opt6)
  source 1..2094: mol_type = other RNA
gggagagcggctcggccattttgtcccagtcagtccggaggctgcggctgcagaagtaccgcctgcggagtaactgcaaagaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 311 - RNA, 2094 nt, synthetic construct
  misc_feature 1..2094: note = mRNA product Design e-6 comprising derived and/or modified sequence from HRSV(A2)__F0 (opt11)
  source 1..2094: mol_type = other RNA
gggagagcggctcggccattttgtcccagtcagtccggaggctgcggctgcagaagtaccgcctgcggagtaactgcaaagaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 312 - RNA, 2310 nt, synthetic construct
  misc_feature 1..2310: note = mRNA product Design f-1 comprising derived and/or modified sequence from HRSV(A2)__F0 (artificial)
  source 1..2310: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 313 - RNA, 2310 nt, synthetic construct
  misc_feature 1..2310: note = mRNA product Design f-1 comprising derived and/or modified sequence from HRSV(A2)__F0 (opt1)
  source 1..2310: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 314 - RNA, 2310 nt, synthetic construct
  misc_feature 1..2310: note = mRNA product Design f-1 comprising derived and/or modified sequence from HRSV(A2)__F0 (opt1)
  source 1..2310: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 315 - RNA, 2310 nt, synthetic construct
  misc_feature 1..2310: note = mRNA product Design f-1 comprising derived and/or modified sequence from HRSV(A2)__F0 (opt2)
  source 1..2310: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 316 - RNA, 2310 nt, synthetic construct
  misc_feature 1..2310: note = mRNA product Design f-1 comprising derived and/or modified sequence from HRSV(A2)__F0 (opt3)
  source 1..2310: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 317 - RNA, 2310 nt, synthetic construct
  misc_feature 1..2310: note = mRNA product Design f-1 comprising derived and/or modified sequence from HRSV(A2)__F0 (opt4)
  source 1..2310: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 318 - RNA, 2310 nt, synthetic construct
  misc_feature 1..2310: note = mRNA product Design f-1 comprising derived and/or modified sequence from HRSV(A2)__F0 (opt5)
  source 1..2310: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 319 - RNA, 2310 nt, synthetic construct
  misc_feature 1..2310: note = mRNA product Design f-1 comprising derived and/or modified sequence from HRSV(A2)__F0 (opt6)
  source 1..2310: mol_type = other RNA
gggagagcggctcggccattttgtcccagtcagtccggaggctgcggctgcagaagtaccgcctgcggagtaactgcaaagaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 320 - RNA, 2310 nt, synthetic construct
  misc_feature 1..2310: note = mRNA product Design f-1 comprising derived and/or modified sequence from HRSV(A2)__F0 (opt11)
  source 1..2310: mol_type = other RNA
gggagagcggctcggccattttgtcccagtcagtccggaggctgcggctgcagaagtaccgcctgcggagtaactgcaaagaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 321 - RNA, 2090 nt, synthetic construct
  misc_feature 1..2090: note = mRNA product Design f-2 comprising derived and/or modified sequence from HRSV(A2)__F0 (artificial)
  source 1..2090: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 322 - RNA, 2090 nt, synthetic construct
  misc_feature 1..2090: note = mRNA product Design f-2 comprising derived and/or modified sequence from HRSV(A2)__F0 (opt1)
  source 1..2090: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 323 - RNA, 2090 nt, synthetic construct
  misc_feature 1..2090: note = mRNA product Design f-2 comprising derived and/or modified sequence from HRSV(A2)__F0 (opt1)
  source 1..2090: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 324 - RNA, 2090 nt, synthetic construct
  misc_feature 1..2090: note = mRNA product Design f-2 comprising derived and/or modified sequence from HRSV(A2)__F0 (opt2)
  source 1..2090: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 325 - RNA, 2090 nt, synthetic construct
  misc_feature 1..2090: note = mRNA product Design f-2 comprising derived and/or modified sequence from HRSV(A2)__F0 (opt3)
  source 1..2090: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 326 - RNA, 2090 nt, synthetic construct
  misc_feature 1..2090: note = mRNA product Design f-2 comprising derived and/or modified sequence from HRSV(A2)__F0 (opt4)
  source 1..2090: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 327 - RNA, 2090 nt, synthetic construct
  misc_feature 1..2090: note = mRNA product Design f-2 comprising derived and/or modified sequence from HRSV(A2)__F0 (opt5)
  source 1..2090: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 328 - RNA, 2090 nt, synthetic construct
  misc_feature 1..2090: note = mRNA product Design f-2 comprising derived and/or modified sequence from HRSV(A2)__F0 (opt6)
  source 1..2090: mol_type = other RNA
gggagagcggctcggccattttgtcccagtcagtccggaggctgcggctgcagaagtaccgcctgcggagtaactgcaaagaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 329 - RNA, 2090 nt, synthetic construct
  misc_feature 1..2090: note = mRNA product Design f-2 comprising derived and/or modified sequence from HRSV(A2)__F0 (opt11)
  source 1..2090: mol_type = other RNA
gggagagcggctcggccattttgtcccagtcagtccggaggctgcggctgcagaagtaccgcctgcggagtaactgcaaagaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 330 - RNA, 2081 nt, synthetic construct
  misc_feature 1..2081: note = mRNA product Design f-3 comprising derived and/or modified sequence from HRSV(A2)__F0 (artificial)
  source 1..2081: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 331 - RNA, 2081 nt, synthetic construct
  misc_feature 1..2081: note = mRNA product Design f-3 comprising derived and/or modified sequence from HRSV(A2)__F0 (opt1)
  source 1..2081: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 332 - RNA, 2081 nt, synthetic construct
  misc_feature 1..2081: note = mRNA product Design f-3 comprising derived and/or modified sequence from HRSV(A2)__F0 (opt1)
  source 1..2081: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 333 - RNA, 2081 nt, synthetic construct
  misc_feature 1..2081: note = mRNA product Design f-3 comprising derived and/or modified sequence from HRSV(A2)__F0 (opt2)
  source 1..2081: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 334 - RNA, 2081 nt, synthetic construct
  misc_feature 1..2081: note = mRNA product Design f-3 comprising derived and/or modified sequence from HRSV(A2)__F0 (opt3)
  source 1..2081: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 335 - RNA, 2081 nt, synthetic construct
  misc_feature 1..2081: note = mRNA product Design f-3 comprising derived and/or modified sequence from HRSV(A2)__F0 (opt4)
  source 1..2081: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 336 - RNA, 2081 nt, synthetic construct
  misc_feature 1..2081: note = mRNA product Design f-3 comprising derived and/or modified sequence from HRSV(A2)__F0 (opt5)
  source 1..2081: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 337 - RNA, 2081 nt, synthetic construct
  misc_feature 1..2081: note = mRNA product Design f-3 comprising derived and/or modified sequence from HRSV(A2)__F0 (opt6)
  source 1..2081: mol_type = other RNA
gggagagtcccgcagtcggcgtccagcggctctgcttgttcgtgtgtgtgtcgttgcaggccttattcaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 338 - RNA, 2081 nt, synthetic construct
  misc_feature 1..2081: note = mRNA product Design f-3 comprising derived and/or modified sequence from HRSV(A2)__F0 (opt11)
  source 1..2081: mol_type = other RNA
gggagagtcccgcagtcggcgtccagcggctctgcttgttcgtgtgtgtgtcgttgcaggccttattcaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 339 - RNA, 2297 nt, synthetic construct
  misc_feature 1..2297: note = mRNA product Design f-4 comprising derived and/or modified sequence from HRSV(A2)__F0 (artificial)
  source 1..2297: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 340 - RNA, 2297 nt, synthetic construct
  misc_feature 1..2297: note = mRNA product Design f-4 comprising derived and/or modified sequence from HRSV(A2)__F0 (opt1)
  source 1..2297: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 341 - RNA, 2297 nt, synthetic construct
  misc_feature 1..2297: note = mRNA product Design f-4 comprising derived and/or modified sequence from HRSV(A2)__F0 (opt1)
  source 1..2297: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 342 - RNA, 2297 nt, synthetic construct
  misc_feature 1..2297: note = mRNA product Design f-4 comprising derived and/or modified sequence from HRSV(A2)__F0 (opt2)
  source 1..2297: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 343 - RNA, 2297 nt, synthetic construct
  misc_feature 1..2297: note = mRNA product Design f-4 comprising derived and/or modified sequence from HRSV(A2)__F0 (opt3)
  source 1..2297: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 344 - RNA, 2297 nt, synthetic construct
  misc_feature 1..2297: note = mRNA product Design f-4 comprising derived and/or modified sequence from HRSV(A2)__F0 (opt4)
  source 1..2297: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 345 - RNA, 2297 nt, synthetic construct
  misc_feature 1..2297: note = mRNA product Design f-4 comprising derived and/or modified sequence from HRSV(A2)__F0 (opt5)
  source 1..2297: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 346 - RNA, 2297 nt, synthetic construct
  misc_feature 1..2297: note = mRNA product Design f-4 comprising derived and/or modified sequence from HRSV(A2)__F0 (opt6)
  source 1..2297: mol_type = other RNA
gggagagtcccgcagtcggcgtccagcggctctgcttgttcgtgtgtgtgtcgttgcaggccttattcaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 347 - RNA, 2297 nt, synthetic construct
  misc_feature 1..2297: note = mRNA product Design f-4 comprising derived and/or modified sequence from HRSV(A2)__F0 (opt11)
  source 1..2297: mol_type = other RNA
gggagagtcccgcagtcggcgtccagcggctctgcttgttcgtgtgtgtgtcgttgcaggccttattcaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 348 - RNA, 2073 nt, synthetic construct
  misc_feature 1..2073: note = mRNA product Design f-5 comprising derived and/or modified sequence from HRSV(A2)__F0 (artificial)
  source 1..2073: mol_type = other RNA
gggagactttcccattctgtagcagaatttggtgttgcctgtggtcttggtcccgcggagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 349 - RNA, 2073 nt, synthetic construct
  misc_feature 1..2073: note = mRNA product Design f-5 comprising derived and/or modified sequence from HRSV(A2)__F0 (opt1)
  source 1..2073: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 350 - RNA, 2073 nt, synthetic construct
  misc_feature 1..2073: note = mRNA product Design f-5 comprising derived and/or modified sequence from HRSV(A2)__F0 (opt1)
  source 1..2073: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 351 - RNA, 2073 nt, synthetic construct
  misc_feature 1..2073: note = mRNA product Design f-5 comprising derived and/or modified sequence from HRSV(A2)__F0 (opt2)
  source 1..2073: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 352 - RNA, 2073 nt, synthetic construct
  misc_feature 1..2073: note = mRNA product Design f-5 comprising derived and/or modified sequence from HRSV(A2)__F0 (opt3)
  source 1..2073: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 353 - RNA, 2073 nt, synthetic construct
  misc_feature 1..2073: note = mRNA product Design f-5 comprising derived and/or modified sequence from HRSV(A2)__F0 (opt4)
  source 1..2073: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 354 - RNA, 2073 nt, synthetic construct
  misc_feature 1..2073: note = mRNA product Design f-5 comprising derived and/or modified sequence from HRSV(A2)__F0 (opt5)
  source 1..2073: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 355 - RNA, 2073 nt, synthetic construct
  misc_feature 1..2073: note = mRNA product Design f-5 comprising derived and/or modified sequence from HRSV(A2)__F0 (opt6)
  source 1..2073: mol_type = other RNA
gggagactttcccattctgtagcagaatttggtgttgcctgtggtcttggtcccgcggagaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 356 - RNA, 2073 nt, synthetic construct
  misc_feature 1..2073: note = mRNA product Design f-5 comprising derived and/or modified sequence from HRSV(A2)__F0 (opt11)
  source 1..2073: mol_type = other RNA
gggagactttcccattctgtagcagaatttggtgttgcctgtggtcttggtcccgcggagaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 357 - RNA, 2069 nt, synthetic construct
  misc_feature 1..2069: note = mRNA product Design g-1 comprising derived and/or modified sequence from HRSV(A2)__F0 (artificial)
  source 1..2069: mol_type = other RNA
gggagactttcccattctgtagcagaatttggtgttgcctgtggtcttggtcccgcggagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 358 - RNA, 2069 nt, synthetic construct
  misc_feature 1..2069: note = mRNA product Design g-1 comprising derived and/or modified sequence from HRSV(A2)__F0 (opt1)
  source 1..2069: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 359 - RNA, 2069 nt, synthetic construct
  misc_feature 1..2069: note = mRNA product Design g-1 comprising derived and/or modified sequence from HRSV(A2)__F0 (opt1)
  source 1..2069: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 360 - RNA, 2069 nt, synthetic construct
  misc_feature 1..2069: note = mRNA product Design g-1 comprising derived and/or modified sequence from HRSV(A2)__F0 (opt2)
  source 1..2069: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 361 - RNA, 2069 nt, synthetic construct
  misc_feature 1..2069: note = mRNA product Design g-1 comprising derived and/or modified sequence from HRSV(A2)__F0 (opt3)
  source 1..2069: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 362 - RNA, 2069 nt, synthetic construct
  misc_feature 1..2069: note = mRNA product Design g-1 comprising derived and/or modified sequence from HRSV(A2)__F0 (opt4)
  source 1..2069: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 363 - RNA, 2069 nt, synthetic construct
  misc_feature 1..2069: note = mRNA product Design g-1 comprising derived and/or modified sequence from HRSV(A2)__F0 (opt5)
  source 1..2069: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 364 - RNA, 2069 nt, synthetic construct
  misc_feature 1..2069: note = mRNA product Design g-1 comprising derived and/or modified sequence from HRSV(A2)__F0 (opt6)
  source 1..2069: mol_type = other RNA
gggagactttcccattctgtagcagaatttggtgttgcctgtggtcttggtcccgcggagaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 365 - RNA, 2069 nt, synthetic construct
  misc_feature 1..2069: note = mRNA product Design g-1 comprising derived and/or modified sequence from HRSV(A2)__F0 (opt11)
  source 1..2069: mol_type = other RNA
gggagactttcccattctgtagcagaatttggtgttgcctgtggtcttggtcccgcggagaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 366 - RNA, 2084 nt, synthetic construct
  misc_feature 1..2084: note = mRNA product Design g-2 comprising derived and/or modified sequence from HRSV(A2)__F0 (artificial)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 367 - RNA, 2084 nt, synthetic construct
  misc_feature 1..2084: note = mRNA product Design g-2 comprising derived and/or modified sequence from HRSV(A2)__F0 (opt1)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 368 - RNA, 2084 nt, synthetic construct
  misc_feature 1..2084: note = mRNA product Design g-2 comprising derived and/or modified sequence from HRSV(A2)__F0 (opt1)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 369 - RNA, 2084 nt, synthetic construct
  misc_feature 1..2084: note = mRNA product Design g-2 comprising derived and/or modified sequence from HRSV(A2)__F0 (opt2)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 370 - RNA, 2084 nt, synthetic construct
  misc_feature 1..2084: note = mRNA product Design g-2 comprising derived and/or modified sequence from HRSV(A2)__F0 (opt3)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 371 - RNA, 2084 nt, synthetic construct
  misc_feature 1..2084: note = mRNA product Design g-2 comprising derived and/or modified sequence from HRSV(A2)__F0 (opt4)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 372 - RNA, 2084 nt, synthetic construct
  misc_feature 1..2084: note = mRNA product Design g-2 comprising derived and/or modified sequence from HRSV(A2)__F0 (opt5)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 373 - RNA, 2084 nt, synthetic construct
  misc_feature 1..2084: note = mRNA product Design g-2 comprising derived and/or modified sequence from HRSV(A2)__F0 (opt6)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 374 - RNA, 2084 nt, synthetic construct
  misc_feature 1..2084: note = mRNA product Design g-2 comprising derived and/or modified sequence from HRSV(A2)__F0 (opt11)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 375 - RNA, 2316 nt, synthetic construct
  misc_feature 1..2316: note = mRNA product Design g-3 comprising derived and/or modified sequence from HRSV(A2)__F0 (artificial)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 376 - RNA, 2316 nt, synthetic construct
  misc_feature 1..2316: note = mRNA product Design g-3 comprising derived and/or modified sequence from HRSV(A2)__F0 (opt1)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 377 - RNA, 2316 nt, synthetic construct
  misc_feature 1..2316: note = mRNA product Design g-3 comprising derived and/or modified sequence from HRSV(A2)__F0 (opt1)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 378 - RNA, 2316 nt, synthetic construct
  misc_feature 1..2316: note = mRNA product Design g-3 comprising derived and/or modified sequence from HRSV(A2)__F0 (opt2)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 379 - RNA, 2316 nt, synthetic construct
  misc_feature 1..2316: note = mRNA product Design g-3 comprising derived and/or modified sequence from HRSV(A2)__F0 (opt3)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 380 - RNA, 2316 nt, synthetic construct
  misc_feature 1..2316: note = mRNA product Design g-3 comprising derived and/or modified sequence from HRSV(A2)__F0 (opt4)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 381 - RNA, 2316 nt, synthetic construct
  misc_feature 1..2316: note = mRNA product Design g-3 comprising derived and/or modified sequence from HRSV(A2)__F0 (opt5)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 382 - RNA, 2316 nt, synthetic construct
  misc_feature 1..2316: note = mRNA product Design g-3 comprising derived and/or modified sequence from HRSV(A2)__F0 (opt6)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 383 - RNA, 2316 nt, synthetic construct
  misc_feature 1..2316: note = mRNA product Design g-3 comprising derived and/or modified sequence from HRSV(A2)__F0 (opt11)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 384 - RNA, 2111 nt, synthetic construct
  misc_feature 1..2111: note = mRNA product Design g-4 comprising derived and/or modified sequence from HRSV(A2)__F0 (artificial)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 385 - RNA, 2111 nt, synthetic construct
  misc_feature 1..2111: note = mRNA product Design g-4 comprising derived and/or modified sequence from HRSV(A2)__F0 (opt1)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 386 - RNA, 2111 nt, synthetic construct
  misc_feature 1..2111: note = mRNA product Design g-4 comprising derived and/or modified sequence from HRSV(A2)__F0 (opt1)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 387 - RNA, 2111 nt, synthetic construct
  misc_feature 1..2111: note = mRNA product Design g-4 comprising derived and/or modified sequence from HRSV(A2)__F0 (opt2)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 388 - RNA, 2111 nt, synthetic construct
  misc_feature 1..2111: note = mRNA product Design g-4 comprising derived and/or modified sequence from HRSV(A2)__F0 (opt3)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 389 - RNA, 2111 nt, synthetic construct
  misc_feature 1..2111: note = mRNA product Design g-4 comprising derived and/or modified sequence from HRSV(A2)__F0 (opt4)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 390 - RNA, 2111 nt, synthetic construct
  misc_feature 1..2111: note = mRNA product Design g-4 comprising derived and/or modified sequence from HRSV(A2)__F0 (opt5)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 391 - RNA, 2111 nt, synthetic construct
  misc_feature 1..2111: note = mRNA product Design g-4 comprising derived and/or modified sequence from HRSV(A2)__F0 (opt6)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 392 - RNA, 2111 nt, synthetic construct
  misc_feature 1..2111: note = mRNA product Design g-4 comprising derived and/or modified sequence from HRSV(A2)__F0 (opt11)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 393 - RNA, 2087 nt, synthetic construct
  misc_feature 1..2087: note = mRNA product Design g-5 comprising derived and/or modified sequence from HRSV(A2)__F0 (artificial)
  source 1..2087: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 394 - RNA, 2087 nt, synthetic construct
  misc_feature 1..2087: note = mRNA product Design g-5 comprising derived and/or modified sequence from HRSV(A2)__F0 (opt1)
  source 1..2087: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 395 - RNA, 2087 nt, synthetic construct
  misc_feature 1..2087: note = mRNA product Design g-5 comprising derived and/or modified sequence from HRSV(A2)__F0 (opt1)
  source 1..2087: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 396 - RNA, 2087 nt, synthetic construct
  misc_feature 1..2087: note = mRNA product Design g-5 comprising derived and/or modified sequence from HRSV(A2)__F0 (opt2)
  source 1..2087: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 397 - RNA, 2087 nt, synthetic construct
  misc_feature 1..2087: note = mRNA product Design g-5 comprising derived and/or modified sequence from HRSV(A2)__F0 (opt3)
  source 1..2087: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 398 - RNA, 2087 nt, synthetic construct
  misc_feature 1..2087: note = mRNA product Design g-5 comprising derived and/or modified sequence from HRSV(A2)__F0 (opt4)
  source 1..2087: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 399 - RNA, 2087 nt, synthetic construct
  misc_feature 1..2087: note = mRNA product Design g-5 comprising derived and/or modified sequence from HRSV(A2)__F0 (opt5)
  source 1..2087: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 400 - RNA, 2087 nt, synthetic construct
  misc_feature 1..2087: note = mRNA product Design g-5 comprising derived and/or modified sequence from HRSV(A2)__F0 (opt6)
  source 1..2087: mol_type = other RNA
gggagacccgtgacccggaagttgtacggctacgcgactttccctcccacaaaccctcgcgcccttcctttcctacttgggcccggcagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 401 - RNA, 2087 nt, synthetic construct
  misc_feature 1..2087: note = mRNA product Design g-5 comprising derived and/or modified sequence from HRSV(A2)__F0 (opt11)
  source 1..2087: mol_type = other RNA
gggagacccgtgacccggaagttgtacggctacgcgactttccctcccacaaaccctcgcgcccttcctttcctacttgggcccggcagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 402 - RNA, 2103 nt, synthetic construct
  misc_feature 1..2103: note = mRNA product Design h-1 comprising derived and/or modified sequence from HRSV(A2)__F0 (artificial)
  source 1..2103: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 403 - RNA, 2103 nt, synthetic construct
  misc_feature 1..2103: note = mRNA product Design h-1 comprising derived and/or modified sequence from HRSV(A2)__F0 (opt1)
  source 1..2103: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 404 - RNA, 2103 nt, synthetic construct
  misc_feature 1..2103: note = mRNA product Design h-1 comprising derived and/or modified sequence from HRSV(A2)__F0 (opt1)
  source 1..2103: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 405 - RNA, 2103 nt, synthetic construct
  misc_feature 1..2103: note = mRNA product Design h-1 comprising derived and/or modified sequence from HRSV(A2)__F0 (opt2)
  source 1..2103: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 406 - RNA, 2103 nt, synthetic construct
  misc_feature 1..2103: note = mRNA product Design h-1 comprising derived and/or modified sequence from HRSV(A2)__F0 (opt3)
  source 1..2103: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 407 - RNA, 2103 nt, synthetic construct
  misc_feature 1..2103: note = mRNA product Design h-1 comprising derived and/or modified sequence from HRSV(A2)__F0 (opt4)
  source 1..2103: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 408 - RNA, 2103 nt, synthetic construct
  misc_feature 1..2103: note = mRNA product Design h-1 comprising derived and/or modified sequence from HRSV(A2)__F0 (opt5)
  source 1..2103: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 409 - RNA, 2103 nt, synthetic construct
  misc_feature 1..2103: note = mRNA product Design h-1 comprising derived and/or modified sequence from HRSV(A2)__F0 (opt6)
  source 1..2103: mol_type = other RNA
gggagacccgtgacccggaagttgtacggctacgcgactttccctcccacaaaccctcgcgcccttcctttcctacttgggcccggcagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 410 - RNA, 2103 nt, synthetic construct
  misc_feature 1..2103: note = mRNA product Design h-1 comprising derived and/or modified sequence from HRSV(A2)__F0 (opt11)
  source 1..2103: mol_type = other RNA
gggagacccgtgacccggaagttgtacggctacgcgactttccctcccacaaaccctcgcgcccttcctttcctacttgggcccggcagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 411 - RNA, 2319 nt, synthetic construct
  misc_feature 1..2319: note = mRNA product Design h-2 comprising derived and/or modified sequence from HRSV(A2)__F0 (artificial)
  source 1..2319: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 412 - RNA, 2319 nt, synthetic construct
  misc_feature 1..2319: note = mRNA product Design h-2 comprising derived and/or modified sequence from HRSV(A2)__F0 (opt1)
  source 1..2319: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 413 - RNA, 2319 nt, synthetic construct
  misc_feature 1..2319: note = mRNA product Design h-2 comprising derived and/or modified sequence from HRSV(A2)__F0 (opt1)
  source 1..2319: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 414 - RNA, 2319 nt, synthetic construct
  misc_feature 1..2319: note = mRNA product Design h-2 comprising derived and/or modified sequence from HRSV(A2)__F0 (opt2)
  source 1..2319: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 415 - RNA, 2319 nt, synthetic construct
  misc_feature 1..2319: note = mRNA product Design h-2 comprising derived and/or modified sequence from HRSV(A2)__F0 (opt3)
  source 1..2319: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 416 - RNA, 2319 nt, synthetic construct
  misc_feature 1..2319: note = mRNA product Design h-2 comprising derived and/or modified sequence from HRSV(A2)__F0 (opt4)
  source 1..2319: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 417 - RNA, 2319 nt, synthetic construct
  misc_feature 1..2319: note = mRNA product Design h-2 comprising derived and/or modified sequence from HRSV(A2)__F0 (opt5)
  source 1..2319: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 418 - RNA, 2319 nt, synthetic construct
  misc_feature 1..2319: note = mRNA product Design h-2 comprising derived and/or modified sequence from HRSV(A2)__F0 (opt6)
  source 1..2319: mol_type = other RNA
gggagacccgtgacccggaagttgtacggctacgcgactttccctcccacaaaccctcgcgcccttcctttcctacttgggcccggcagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 419 - RNA, 2319 nt, synthetic construct
  misc_feature 1..2319: note = mRNA product Design h-2 comprising derived and/or modified sequence from HRSV(A2)__F0 (opt11)
  source 1..2319: mol_type = other RNA
gggagacccgtgacccggaagttgtacggctacgcgactttccctcccacaaaccctcgcgcccttcctttcctacttgggcccggcagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 420 - RNA, 2099 nt, synthetic construct
  misc_feature 1..2099: note = mRNA product Design h-3 comprising derived and/or modified sequence from HRSV(A2)__F0 (artificial)
  source 1..2099: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 421 - RNA, 2099 nt, synthetic construct
  misc_feature 1..2099: note = mRNA product Design h-3 comprising derived and/or modified sequence from HRSV(A2)__F0 (opt1)
  source 1..2099: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 422 - RNA, 2099 nt, synthetic construct
  misc_feature 1..2099: note = mRNA product Design h-3 comprising derived and/or modified sequence from HRSV(A2)__F0 (opt1)
  source 1..2099: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 423 - RNA, 2099 nt, synthetic construct
  misc_feature 1..2099: note = mRNA product Design h-3 comprising derived and/or modified sequence from HRSV(A2)__F0 (opt2)
  source 1..2099: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 424 - RNA, 2099 nt, synthetic construct
  misc_feature 1..2099: note = mRNA product Design h-3 comprising derived and/or modified sequence from HRSV(A2)__F0 (opt3)
  source 1..2099: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 425 - RNA, 2099 nt, synthetic construct
  misc_feature 1..2099: note = mRNA product Design h-3 comprising derived and/or modified sequence from HRSV(A2)__F0 (opt4)
  source 1..2099: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 426 - RNA, 2099 nt, synthetic construct
  misc_feature 1..2099: note = mRNA product Design h-3 comprising derived and/or modified sequence from HRSV(A2)__F0 (opt5)
  source 1..2099: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 427 - RNA, 2099 nt, synthetic construct
  misc_feature 1..2099: note = mRNA product Design h-3 comprising derived and/or modified sequence from HRSV(A2)__F0 (opt6)
  source 1..2099: mol_type = other RNA
gggagacccgtgacccggaagttgtacggctacgcgactttccctcccacaaaccctcgcgcccttcctttcctacttgggcccggcagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 428 - RNA, 2099 nt, synthetic construct
  misc_feature 1..2099: note = mRNA product Design h-3 comprising derived and/or modified sequence from HRSV(A2)__F0 (opt11)
  source 1..2099: mol_type = other RNA
gggagacccgtgacccggaagttgtacggctacgcgactttccctcccacaaaccctcgcgcccttcctttcctacttgggcccggcagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 429 - RNA, 2162 nt, synthetic construct
  misc_feature 1..2162: note = mRNA product Design h-4 comprising derived and/or modified sequence from HRSV(A2)__F0 (artificial)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 430 - RNA, 2162 nt, synthetic construct
  misc_feature 1..2162: note = mRNA product Design h-4 comprising derived and/or modified sequence from HRSV(A2)__F0 (opt1)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 431 - RNA, 2162 nt, synthetic construct
  misc_feature 1..2162: note = mRNA product Design h-4 comprising derived and/or modified sequence from HRSV(A2)__F0 (opt1)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 432 - RNA, 2162 nt, synthetic construct
  misc_feature 1..2162: note = mRNA product Design h-4 comprising derived and/or modified sequence from HRSV(A2)__F0 (opt2)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 433 - RNA, 2162 nt, synthetic construct
  misc_feature 1..2162: note = mRNA product Design h-4 comprising derived and/or modified sequence from HRSV(A2)__F0 (opt3)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 434 - RNA, 2162 nt, synthetic construct
  misc_feature 1..2162: note = mRNA product Design h-4 comprising derived and/or modified sequence from HRSV(A2)__F0 (opt4)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 435 - RNA, 2162 nt, synthetic construct
  misc_feature 1..2162: note = mRNA product Design h-4 comprising derived and/or modified sequence from HRSV(A2)__F0 (opt5)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 436 - RNA, 2162 nt, synthetic construct
  misc_feature 1..2162: note = mRNA product Design h-4 comprising derived and/or modified sequence from HRSV(A2)__F0 (opt6)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 437 - RNA, 2162 nt, synthetic construct
  misc_feature 1..2162: note = mRNA product Design h-4 comprising derived and/or modified sequence from HRSV(A2)__F0 (opt11)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 438 - RNA, 2178 nt, synthetic construct
  misc_feature 1..2178: note = mRNA product Design h-5 comprising derived and/or modified sequence from HRSV(A2)__F0 (artificial)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 439 - RNA, 2178 nt, synthetic construct
  misc_feature 1..2178: note = mRNA product Design h-5 comprising derived and/or modified sequence from HRSV(A2)__F0 (opt1)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 440 - RNA, 2178 nt, synthetic construct
  misc_feature 1..2178: note = mRNA product Design h-5 comprising derived and/or modified sequence from HRSV(A2)__F0 (opt1)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 441 - RNA, 2178 nt, synthetic construct
  misc_feature 1..2178: note = mRNA product Design h-5 comprising derived and/or modified sequence from HRSV(A2)__F0 (opt2)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 442 - RNA, 2178 nt, synthetic construct
  misc_feature 1..2178: note = mRNA product Design h-5 comprising derived and/or modified sequence from HRSV(A2)__F0 (opt3)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 443 - RNA, 2178 nt, synthetic construct
  misc_feature 1..2178: note = mRNA product Design h-5 comprising derived and/or modified sequence from HRSV(A2)__F0 (opt4)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 444 - RNA, 2178 nt, synthetic construct
  misc_feature 1..2178: note = mRNA product Design h-5 comprising derived and/or modified sequence from HRSV(A2)__F0 (opt5)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 445 - RNA, 2178 nt, synthetic construct
  misc_feature 1..2178: note = mRNA product Design h-5 comprising derived and/or modified sequence from HRSV(A2)__F0 (opt6)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 446 - RNA, 2178 nt, synthetic construct
  misc_feature 1..2178: note = mRNA product Design h-5 comprising derived and/or modified sequence from HRSV(A2)__F0 (opt11)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 447 - RNA, 2111 nt, synthetic construct
  misc_feature 1..2111: note = mRNA product Design i-1 comprising derived and/or modified sequence from HRSV(A2)__F0 (artificial)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 448 - RNA, 2111 nt, synthetic construct
  misc_feature 1..2111: note = mRNA product Design i-1 comprising derived and/or modified sequence from HRSV(A2)__F0 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 449 - RNA, 2111 nt, synthetic construct
  misc_feature 1..2111: note = mRNA product Design i-1 comprising derived and/or modified sequence from HRSV(A2)__F0 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 450 - RNA, 2111 nt, synthetic construct
  misc_feature 1..2111: note = mRNA product Design i-1 comprising derived and/or modified sequence from HRSV(A2)__F0 (opt2)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 451 - RNA, 2111 nt, synthetic construct
  misc_feature 1..2111: note = mRNA product Design i-1 comprising derived and/or modified sequence from HRSV(A2)__F0 (opt3)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 452 - RNA, 2111 nt, synthetic construct
  misc_feature 1..2111: note = mRNA product Design i-1 comprising derived and/or modified sequence from HRSV(A2)__F0 (opt4)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 453 - RNA, 2111 nt, synthetic construct
  misc_feature 1..2111: note = mRNA product Design i-1 comprising derived and/or modified sequence from HRSV(A2)__F0 (opt5)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 454 - RNA, 2111 nt, synthetic construct
  misc_feature 1..2111: note = mRNA product Design i-1 comprising derived and/or modified sequence from HRSV(A2)__F0 (opt6)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 455 - RNA, 2111 nt, synthetic construct
  misc_feature 1..2111: note = mRNA product Design i-1 comprising derived and/or modified sequence from HRSV(A2)__F0 (opt11)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 456 - RNA, 2111 nt, synthetic construct
  misc_feature 1..2111: note = mRNA product Design i-2 comprising derived and/or modified sequence from HRSV(A2)__F0 (artificial)
  source 1..2111: mol_type = other RNA
gggagaggcgctgcctacggaggtggcagccatctccttctcggcatcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 457 - RNA, 2111 nt, synthetic construct
  misc_feature 1..2111: note = mRNA product Design i-2 comprising derived and/or modified sequence from HRSV(A2)__F0 (opt1)
  source 1..2111: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 458 - RNA, 2111 nt, synthetic construct
  misc_feature 1..2111: note = mRNA product Design i-2 comprising derived and/or modified sequence from HRSV(A2)__F0 (opt1)
  source 1..2111: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 459 - RNA, 2111 nt, synthetic construct
  misc_feature 1..2111: note = mRNA product Design i-2 comprising derived and/or modified sequence from HRSV(A2)__F0 (opt2)
  source 1..2111: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 460 - RNA, 2111 nt, synthetic construct
  misc_feature 1..2111: note = mRNA product Design i-2 comprising derived and/or modified sequence from HRSV(A2)__F0 (opt3)
  source 1..2111: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 461 - RNA, 2111 nt, synthetic construct
  misc_feature 1..2111: note = mRNA product Design i-2 comprising derived and/or modified sequence from HRSV(A2)__F0 (opt4)
  source 1..2111: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 462 - RNA, 2111 nt, synthetic construct
  misc_feature 1..2111: note = mRNA product Design i-2 comprising derived and/or modified sequence from HRSV(A2)__F0 (opt5)
  source 1..2111: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 463 - RNA, 2111 nt, synthetic construct
  misc_feature 1..2111: note = mRNA product Design i-2 comprising derived and/or modified sequence from HRSV(A2)__F0 (opt6)
  source 1..2111: mol_type = other RNA
gggagaggcgctgcctacggaggtggcagccatctccttctcggcatcaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 464 - RNA, 2111 nt, synthetic construct
  misc_feature 1..2111: note = mRNA product Design i-2 comprising derived and/or modified sequence from HRSV(A2)__F0 (opt11)
  source 1..2111: mol_type = other RNA
gggagaggcgctgcctacggaggtggcagccatctccttctcggcatcaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 465 - RNA, 2107 nt, synthetic construct
  misc_feature 1..2107: note = mRNA product Design i-2 comprising derived and/or modified sequence from HRSV(A2)__F0 (artificial)
  source 1..2107: mol_type = other RNA
ggggcgctgcctacggaggtggcagccatctccttctcggcatcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 466 - RNA, 2107 nt, synthetic construct
  misc_feature 1..2107: note = mRNA product Design i-2 comprising derived and/or modified sequence from HRSV(A2)__F0 (opt1) R3737/R3938
  source 1..2107: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 467 - RNA, 2107 nt, synthetic construct
  misc_feature 1..2107: note = mRNA product Design i-2 comprising derived and/or modified sequence from HRSV(A2)__F0 (opt1)
  source 1..2107: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 468 - RNA, 2107 nt, synthetic construct
  misc_feature 1..2107: note = mRNA product Design i-2 comprising derived and/or modified sequence from HRSV(A2)__F0 (opt2)
  source 1..2107: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 469 - RNA, 2107 nt, synthetic construct
  misc_feature 1..2107: note = mRNA product Design i-2 comprising derived and/or modified sequence from HRSV(A2)__F0 (opt3)
  source 1..2107: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 470 - RNA, 2107 nt, synthetic construct
  misc_feature 1..2107: note = mRNA product Design i-2 comprising derived and/or modified sequence from HRSV(A2)__F0 (opt4)
  source 1..2107: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 471 - RNA, 2107 nt, synthetic construct
  misc_feature 1..2107: note = mRNA product Design i-2 comprising derived and/or modified sequence from HRSV(A2)__F0 (opt5)
  source 1..2107: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 472 - RNA, 2107 nt, synthetic construct
  misc_feature 1..2107: note = mRNA product Design i-2 comprising derived and/or modified sequence from HRSV(A2)__F0 (opt6)
  source 1..2107: mol_type = other RNA
ggggcgctgcctacggaggtggcagccatctccttctcggcatcaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 473 - RNA, 2107 nt, synthetic construct
  misc_feature 1..2107: note = mRNA product Design i-2 comprising derived and/or modified sequence from HRSV(A2)__F0 (opt11)
  source 1..2107: mol_type = other RNA
ggggcgctgcctacggaggtggcagccatctccttctcggcatcaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 474 - RNA, 1942 nt, synthetic construct
  misc_feature 1..1942: note = mRNA product Design i-3 comprising derived and/or modified sequence from HRSV(A2)__F0 (artificial)
  source 1..1942: mol_type = other RNA
gggagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagaagcacaccagtcacactaagcaaagatcaactgagtggtataaataatattgcatttagtaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 475 - RNA, 1942 nt, synthetic construct
  misc_feature 1..1942: note = mRNA product Design i-3 comprising derived and/or modified sequence from HRSV(A2)__F0 (opt1) R6939/R7003
  source 1..1942: mol_type = other RNA
gggagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 476 - RNA, 1942 nt, synthetic construct
  misc_feature 1..1942: note = mRNA product Design i-3 comprising derived and/or modified sequence from HRSV(A2)__F0 (opt1)
  source 1..1942: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgcagcacgcccgtgaccctgtccaaggaccagctgagcggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 477 - RNA, 1942 nt, synthetic construct
  misc_feature 1..1942: note = mRNA product Design i-3 comprising derived and/or modified sequence from HRSV(A2)__F0 (opt2)
  source 1..1942: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 478 - RNA, 1942 nt, synthetic construct
  misc_feature 1..1942: note = mRNA product Design i-3 comprising derived and/or modified sequence from HRSV(A2)__F0 (opt3)
  source 1..1942: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtcaacacccgttacgttgagcaaggaccagctctctgggataaacaatatcgctttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 479 - RNA, 1942 nt, synthetic construct
  misc_feature 1..1942: note = mRNA product Design i-3 comprising derived and/or modified sequence from HRSV(A2)__F0 (opt4)
  source 1..1942: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 480 - RNA, 1942 nt, synthetic construct
  misc_feature 1..1942: note = mRNA product Design i-3 comprising derived and/or modified sequence from HRSV(A2)__F0 (opt5)
  source 1..1942: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtccacccccgttacgctgagcaaggaccagctttctggaattaacaatatcgctttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 481 - RNA, 1942 nt, synthetic construct
  misc_feature 1..1942: note = mRNA product Design i-3 comprising derived and/or modified sequence from HRSV(A2)__F0 (opt6)
  source 1..1942: mol_type = other RNA
gggagaaagcttaccatggaacttctaatattaaaagctaacgcaatcactactatcttaaccgcagtaacattctgttttgcatccggccaaaacataacagaagaattttaccaatcaacttgctctgcagtctcaaaaggttatctatctgcattaagaacaggctggtacacctcagtaataacgatcgaactatcaaacatcaaagaaaacaaatgtaatggaacagacgcaaaagtaaaactaatcaaacaagaactagacaaatacaaaaacgcagtaaccgaactccaactcctcatgcaaagtacaccagcaacaaataacagagcaagacgtgaactaccacgttttatgaattacacgctcaataacgcaaaaaaaacaaatgttaccctatcaaaaaaacgaaaaagaagattcctcggattcctactaggcgtaggctcagcaatagcttcaggagtagcagtatcaaaagtactccacctcgaaggagaagtaaacaaaatcaaaagcgctctcctctcaacaaacaaagcagttgtttcactctcaaacggagtatcagtactaacctcaaaagtacttgacctaaaaaattatatagacaaacaactattaccaatagtaaacaaacaaagctgctccatctccaacatcgagacagtcatagaatttcaacaaaaaaataaccgcctattagaaataaccagagaattttcagtaaacgcaggagtaactaccccagtatcaacatatatgttaacaaactcagaactcctaagtctaatcaacgacatgccaataaccaacgaccaaaaaaaactaatgagcaacaatgtacaaatagttcgtcaacaatcttactccataatgtctataataaaagaagaagtactcgcctatgtagtccaactaccactatacggagtcatcgatacaccatgctggaaactccacacatccccactctgtactactaacaccaaagaaggttcaaatatatgcctaaccagaacagatagaggttggtactgcgataatgcaggatcagtatcctttttcccccaagccgaaacatgcaaagttcaatccaatagagtattttgtgatacaatgaactctttaaccctcccatccgaagtcaatctatgtaacgtcgacatatttaacccaaaatacgattgcaaaataatgacatcaaaaacagacgtctcatcctcagttataacgtccttaggcgctatagtatcatgctacggcaaaacaaaatgtacagcatcaaacaaaaacagaggaatcataaaaactttctctaacggttgcgactatgtatccaacaaaggtgtcgacacagtatccgtaggcaacaccctttactatgttaataaacaagaaggaaaatctctatatgtaaaaggcgaaccaattataaatttttacgacccccttgtctttccctctgacgaatttgacgcttccatatcacaagtcaacgaaaaaatcaaccaatccctcgcattcatacgcaaatcagacgaactactacataacgtcaacgcaggcaaatccacaacaaacataatgataaccacaatcataattgtaataatagtaatactactttctctaatagcagtcggattactcttatactgtaaagctcgatcaacaccagtcaccctctctaaagatcaactatccggaatcaacaacatagctttctcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 482 - RNA, 1942 nt, synthetic construct
  misc_feature 1..1942: note = mRNA product Design i-3 comprising derived and/or modified sequence from HRSV(A2)__F0 (opt11)
  source 1..1942: mol_type = other RNA
gggagaaagcttaccatggaactcctcatactcaaagccaacgcaatcacaaccatactcaccgccgtcaccttctgctttgcatctggccagaacatcactgaagagttctaccaatccacatgctccgccgtaagcaaaggctacctatccgccctacgcaccggctggtacaccagcgtaatcaccatagaactctccaatataaaagaaaacaaatgcaacggcaccgacgcaaaagtcaagctaataaaacaagaactcgacaaatacaaaaacgccgttaccgaactccagctactcatgcaatcgaccccagcaaccaacaaccgtgcgagacgcgaactcccccgcttcatgaactacaccctaaacaacgccaaaaagaccaacgtaactctatccaagaaacgcaaacgccgcttcctcggattcctcctcggcgtcggctccgcaatcgccagcggcgtcgccgttagcaaagtccttcacctcgaaggagaagtaaacaaaattaaaagcgccctcttatccacaaacaaggccgtagtatccctgtcaaacggcgtctccgtccttacatccaaagtcctcgacctcaagaactacatagacaaacagctactacccattgtaaataaacaaagctgctcaattagcaacatcgaaaccgtaatcgagttccagcagaaaaacaacagacttctcgaaatcacccgcgagttcagcgtcaacgccggcgtaaccacccctgtctcaacatacatgctaaccaacagcgaactgctctccctcatcaacgacatgcccatcaccaacgaccaaaagaaactcatgagcaacaacgtacaaatcgtgcgccaacagtcctactcaataatgtcaatcatcaaagaagaagtgctagcatacgtcgtacaactaccactctacggcgtaatagataccccctgctggaagctccatacctccccactctgtaccaccaacaccaaagaaggctcaaacatctgcctaacgcgcacagaccgtggatggtactgtgacaacgccggctccgtctccttcttccctcaagccgaaacatgcaaagtccaatccaacagagtcttctgcgataccatgaactccctgacactcccaagcgaagtcaacctttgcaacgtcgatatctttaaccccaaatacgactgcaagatcatgacatcaaaaaccgacgtatcctcctctgtaataacctccctaggcgcaatcgtatcatgctacggcaaaaccaaatgtaccgcctccaacaaaaatcgcggcatcatcaaaaccttctcgaacggctgcgactacgtctccaacaaaggcgtagacacagtttccgtaggcaacaccctctactacgtcaataaacaggaaggcaagtccctctacgtcaaaggcgaacccatcatcaatttctacgaccccctcgttttcccctccgatgagttcgacgcaagcatcagccaggtcaacgaaaagataaaccagtccctcgccttcatccgcaaatcagatgaactccttcacaacgttaacgcaggcaagagcaccaccaacatcatgatcacaactataatcatcgtcataatcgtcatcctactctcactaatcgccgtcggtctcctactatattgtaaagcccgatcaacaccggtcacactctccaaagaccaactctccggaatcaacaatatcgctttctcgaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 483 - protein, 553 aa, synthetic construct
  REGION 1..553: note = derived and/or modified protein sequence (artificial) from HRSV(A2)__F-del
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 484 - RNA, 1662 nt, synthetic construct
  misc_feature 1..1662: note = derived and/or modified CDS sequence (artificial) from HRSV(A2)__F-del
  source 1..1662: mol_type = other RNA
atggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataa

SEQ ID NO: 485 - RNA, 1662 nt, synthetic construct
  misc_feature 1..1662: note = derived and/or modified CDS sequence (opt1) from HRSV(A2)__F-del
  source 1..1662: mol_type = other RNA
atggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 486 - RNA, 1662 nt, synthetic construct
  misc_feature 1..1662: note = derived and/or modified CDS sequence (opt1) from HRSV(A2)__F-del
  source 1..1662: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctga

SEQ ID NO: 487 - RNA, 1662 nt, synthetic construct
  misc_feature 1..1662: note = derived and/or modified CDS sequence (opt2) from HRSV(A2)__F-del
  source 1..1662: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 488 - RNA, 1662 nt, synthetic construct
  misc_feature 1..1662: note = derived and/or modified CDS sequence (opt3) from HRSV(A2)__F-del
  source 1..1662: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtga

SEQ ID NO: 489 - RNA, 1662 nt, synthetic construct
  misc_feature 1..1662: note = derived and/or modified CDS sequence (opt4) from HRSV(A2)__F-del
  source 1..1662: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 490 - RNA, 1662 nt, synthetic construct
  misc_feature 1..1662: note = derived and/or modified CDS sequence (opt5) from HRSV(A2)__F-del
  source 1..1662: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtga

SEQ ID NO: 491 - RNA, 1662 nt, synthetic construct
  misc_feature 1..1662: note = derived and/or modified CDS sequence (opt6) from HRSV(A2)__F-del
  source 1..1662: mol_type = other RNA
atggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataa

SEQ ID NO: 492 - RNA, 1662 nt, synthetic construct
  misc_feature 1..1662: note = derived and/or modified CDS sequence (opt11) from HRSV(A2)__F-del
  source 1..1662: mol_type = other RNA
atggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatag

SEQ ID NO: 493 - RNA, 1938 nt, synthetic construct
  misc_feature 1..1938: note = mRNA product Design a-1 comprising derived and/or modified sequence from HRSV(A2)__F-del (artificial)
  source 1..1938: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 494 - RNA, 1938 nt, synthetic construct
  misc_feature 1..1938: note = mRNA product Design a-1 comprising derived and/or modified sequence from HRSV(A2)__F-del (opt1)
  source 1..1938: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 495 - RNA, 1938 nt, synthetic construct
  misc_feature 1..1938: note = mRNA product Design a-1 comprising derived and/or modified sequence from HRSV(A2)__F-del (opt1)
  source 1..1938: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 496 - RNA, 1938 nt, synthetic construct
  misc_feature 1..1938: note = mRNA product Design a-1 comprising derived and/or modified sequence from HRSV(A2)__F-del (opt2)
  source 1..1938: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 497 - RNA, 1938 nt, synthetic construct
  misc_feature 1..1938: note = mRNA product Design a-1 comprising derived and/or modified sequence from HRSV(A2)__F-del (opt3)
  source 1..1938: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 498 - RNA, 1938 nt, synthetic construct
  misc_feature 1..1938: note = mRNA product Design a-1 comprising derived and/or modified sequence from HRSV(A2)__F-del (opt4)
  source 1..1938: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 499 - RNA, 1938 nt, synthetic construct
  misc_feature 1..1938: note = mRNA product Design a-1 comprising derived and/or modified sequence from HRSV(A2)__F-del (opt5)
  source 1..1938: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 500 - RNA, 1938 nt, synthetic construct
  misc_feature 1..1938: note = mRNA product Design a-1 comprising derived and/or modified sequence from HRSV(A2)__F-del (opt6)
  source 1..1938: mol_type = other RNA
gggagagtcccgcagtcggcgtccagcggctctgcttgttcgtgtgtgtgtcgttgcaggccttattcaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 501 - RNA, 1938 nt, synthetic construct
  misc_feature 1..1938: note = mRNA product Design a-1 comprising derived and/or modified sequence from HRSV(A2)__F-del (opt11)
  source 1..1938: mol_type = other RNA
gggagagtcccgcagtcggcgtccagcggctctgcttgttcgtgtgtgtgtcgttgcaggccttattcaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 502 - RNA, 1957 nt, synthetic construct
  misc_feature 1..1957: note = mRNA product Design a-2 comprising derived and/or modified sequence from HRSV(A2)__F-del (artificial)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 503 - RNA, 1957 nt, synthetic construct
  misc_feature 1..1957: note = mRNA product Design a-2 comprising derived and/or modified sequence from HRSV(A2)__F-del (opt1)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 504 - RNA, 1957 nt, synthetic construct
  misc_feature 1..1957: note = mRNA product Design a-2 comprising derived and/or modified sequence from HRSV(A2)__F-del (opt1)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 505 - RNA, 1957 nt, synthetic construct
  misc_feature 1..1957: note = mRNA product Design a-2 comprising derived and/or modified sequence from HRSV(A2)__F-del (opt2)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 506 - RNA, 1957 nt, synthetic construct
  misc_feature 1..1957: note = mRNA product Design a-2 comprising derived and/or modified sequence from HRSV(A2)__F-del (opt3)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 507 - RNA, 1957 nt, synthetic construct
  misc_feature 1..1957: note = mRNA product Design a-2 comprising derived and/or modified sequence from HRSV(A2)__F-del (opt4)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 508 - RNA, 1957 nt, synthetic construct
  misc_feature 1..1957: note = mRNA product Design a-2 comprising derived and/or modified sequence from HRSV(A2)__F-del (opt5)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 509 - RNA, 1957 nt, synthetic construct
  misc_feature 1..1957: note = mRNA product Design a-2 comprising derived and/or modified sequence from HRSV(A2)__F-del (opt6)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 510 - RNA, 1957 nt, synthetic construct
  misc_feature 1..1957: note = mRNA product Design a-2 comprising derived and/or modified sequence from HRSV(A2)__F-del (opt11)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 511 - RNA, 2035 nt, synthetic construct
  misc_feature 1..2035: note = mRNA product Design a-3 comprising derived and/or modified sequence from HRSV(A2)__F-del (artificial)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 512 - RNA, 2035 nt, synthetic construct
  misc_feature 1..2035: note = mRNA product Design a-3 comprising derived and/or modified sequence from HRSV(A2)__F-del (opt1)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 513 - RNA, 2035 nt, synthetic construct
  misc_feature 1..2035: note = mRNA product Design a-3 comprising derived and/or modified sequence from HRSV(A2)__F-del (opt1)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 514 - RNA, 2035 nt, synthetic construct
  misc_feature 1..2035: note = mRNA product Design a-3 comprising derived and/or modified sequence from HRSV(A2)__F-del (opt2)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 515 - RNA, 2035 nt, synthetic construct
  misc_feature 1..2035: note = mRNA product Design a-3 comprising derived and/or modified sequence from HRSV(A2)__F-del (opt3)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 516 - RNA, 2035 nt, synthetic construct
  misc_feature 1..2035: note = mRNA product Design a-3 comprising derived and/or modified sequence from HRSV(A2)__F-del (opt4)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 517 - RNA, 2035 nt, synthetic construct
  misc_feature 1..2035: note = mRNA product Design a-3 comprising derived and/or modified sequence from HRSV(A2)__F-del (opt5)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 518 - RNA, 2035 nt, synthetic construct
  misc_feature 1..2035: note = mRNA product Design a-3 comprising derived and/or modified sequence from HRSV(A2)__F-del (opt6)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 519 - RNA, 2035 nt, synthetic construct
  misc_feature 1..2035: note = mRNA product Design a-3 comprising derived and/or modified sequence from HRSV(A2)__F-del (opt11)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 520 - RNA, 1984 nt, synthetic construct
  misc_feature 1..1984: note = mRNA product Design a-4 comprising derived and/or modified sequence from HRSV(A2)__F-del (artificial)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 521 - RNA, 1984 nt, synthetic construct
  misc_feature 1..1984: note = mRNA product Design a-4 comprising derived and/or modified sequence from HRSV(A2)__F-del (opt1)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 522 - RNA, 1984 nt, synthetic construct
  misc_feature 1..1984: note = mRNA product Design a-4 comprising derived and/or modified sequence from HRSV(A2)__F-del (opt1)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 523 - RNA, 1984 nt, synthetic construct
  misc_feature 1..1984: note = mRNA product Design a-4 comprising derived and/or modified sequence from HRSV(A2)__F-del (opt2)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 524 - RNA, 1984 nt, synthetic construct
  misc_feature 1..1984: note = mRNA product Design a-4 comprising derived and/or modified sequence from HRSV(A2)__F-del (opt3)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 525 - RNA, 1984 nt, synthetic construct
  misc_feature 1..1984: note = mRNA product Design a-4 comprising derived and/or modified sequence from HRSV(A2)__F-del (opt4)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 526 - RNA, 1984 nt, synthetic construct
  misc_feature 1..1984: note = mRNA product Design a-4 comprising derived and/or modified sequence from HRSV(A2)__F-del (opt5)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 527 - RNA, 1984 nt, synthetic construct
  misc_feature 1..1984: note = mRNA product Design a-4 comprising derived and/or modified sequence from HRSV(A2)__F-del (opt6)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 528 - RNA, 1984 nt, synthetic construct
  misc_feature 1..1984: note = mRNA product Design a-4 comprising derived and/or modified sequence from HRSV(A2)__F-del (opt11)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 529 - RNA, 1930 nt, synthetic construct
  misc_feature 1..1930: note = mRNA product Design a-5 comprising derived and/or modified sequence from HRSV(A2)__F-del (artificial)
  source 1..1930: mol_type = other RNA
gggagactttcccattctgtagcagaatttggtgttgcctgtggtcttggtcccgcggagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 530 - RNA, 1930 nt, synthetic construct
  misc_feature 1..1930: note = mRNA product Design a-5 comprising derived and/or modified sequence from HRSV(A2)__F-del (opt1)
  source 1..1930: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 531 - RNA, 1930 nt, synthetic construct
  misc_feature 1..1930: note = mRNA product Design a-5 comprising derived and/or modified sequence from HRSV(A2)__F-del (opt1)
  source 1..1930: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 532 - RNA, 1930 nt, synthetic construct
  misc_feature 1..1930: note = mRNA product Design a-5 comprising derived and/or modified sequence from HRSV(A2)__F-del (opt2)
  source 1..1930: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 533 - RNA, 1930 nt, synthetic construct
  misc_feature 1..1930: note = mRNA product Design a-5 comprising derived and/or modified sequence from HRSV(A2)__F-del (opt3)
  source 1..1930: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 534 - RNA, 1930 nt, synthetic construct
  misc_feature 1..1930: note = mRNA product Design a-5 comprising derived and/or modified sequence from HRSV(A2)__F-del (opt4)
  source 1..1930: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 535 - RNA, 1930 nt, synthetic construct
  misc_feature 1..1930: note = mRNA product Design a-5 comprising derived and/or modified sequence from HRSV(A2)__F-del (opt5)
  source 1..1930: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 536 - RNA, 1930 nt, synthetic construct
  misc_feature 1..1930: note = mRNA product Design a-5 comprising derived and/or modified sequence from HRSV(A2)__F-del (opt6)
  source 1..1930: mol_type = other RNA
gggagactttcccattctgtagcagaatttggtgttgcctgtggtcttggtcccgcggagaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 537 - RNA, 1930 nt, synthetic construct
  misc_feature 1..1930: note = mRNA product Design a-5 comprising derived and/or modified sequence from HRSV(A2)__F-del (opt11)
  source 1..1930: mol_type = other RNA
gggagactttcccattctgtagcagaatttggtgttgcctgtggtcttggtcccgcggagaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 538 - RNA, 2111 nt, synthetic construct
  misc_feature 1..2111: note = mRNA product Design b-1 comprising derived and/or modified sequence from HRSV(A2)__F-del (artificial)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 539 - RNA, 2111 nt, synthetic construct
  misc_feature 1..2111: note = mRNA product Design b-1 comprising derived and/or modified sequence from HRSV(A2)__F-del (opt1)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 540 - RNA, 2111 nt, synthetic construct
  misc_feature 1..2111: note = mRNA product Design b-1 comprising derived and/or modified sequence from HRSV(A2)__F-del (opt1)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 541 - RNA, 2111 nt, synthetic construct
  misc_feature 1..2111: note = mRNA product Design b-1 comprising derived and/or modified sequence from HRSV(A2)__F-del (opt2)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 542 - RNA, 2111 nt, synthetic construct
  misc_feature 1..2111: note = mRNA product Design b-1 comprising derived and/or modified sequence from HRSV(A2)__F-del (opt3)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 543 - RNA, 2111 nt, synthetic construct
  misc_feature 1..2111: note = mRNA product Design b-1 comprising derived and/or modified sequence from HRSV(A2)__F-del (opt4)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 544 - RNA, 2111 nt, synthetic construct
  misc_feature 1..2111: note = mRNA product Design b-1 comprising derived and/or modified sequence from HRSV(A2)__F-del (opt5)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 545 - RNA, 2111 nt, synthetic construct
  misc_feature 1..2111: note = mRNA product Design b-1 comprising derived and/or modified sequence from HRSV(A2)__F-del (opt6)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 546 - RNA, 2111 nt, synthetic construct
  misc_feature 1..2111: note = mRNA product Design b-1 comprising derived and/or modified sequence from HRSV(A2)__F-del (opt11)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 547 - RNA, 1931 nt, synthetic construct
  misc_feature 1..1931: note = mRNA product Design b-2 comprising derived and/or modified sequence from HRSV(A2)__F-del (artificial)
  source 1..1931: mol_type = other RNA
gggagagcctctgctggagtccggggagtggcgttggctgctagagcgaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 548 - RNA, 1931 nt, synthetic construct
  misc_feature 1..1931: note = mRNA product Design b-2 comprising derived and/or modified sequence from HRSV(A2)__F-del (opt1)
  source 1..1931: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 549 - RNA, 1931 nt, synthetic construct
  misc_feature 1..1931: note = mRNA product Design b-2 comprising derived and/or modified sequence from HRSV(A2)__F-del (opt1)
  source 1..1931: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 550 - RNA, 1931 nt, synthetic construct
  misc_feature 1..1931: note = mRNA product Design b-2 comprising derived and/or modified sequence from HRSV(A2)__F-del (opt2)
  source 1..1931: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 551 - RNA, 1931 nt, synthetic construct
  misc_feature 1..1931: note = mRNA product Design b-2 comprising derived and/or modified sequence from HRSV(A2)__F-del (opt3)
  source 1..1931: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 552 - RNA, 1931 nt, synthetic construct
  misc_feature 1..1931: note = mRNA product Design b-2 comprising derived and/or modified sequence from HRSV(A2)__F-del (opt4)
  source 1..1931: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 553 - RNA, 1931 nt, synthetic construct
  misc_feature 1..1931: note = mRNA product Design b-2 comprising derived and/or modified sequence from HRSV(A2)__F-del (opt5)
  source 1..1931: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 554 - RNA, 1931 nt, synthetic construct
  misc_feature 1..1931: note = mRNA product Design b-2 comprising derived and/or modified sequence from HRSV(A2)__F-del (opt6)
  source 1..1931: mol_type = other RNA
gggagagcctctgctggagtccggggagtggcgttggctgctagagcgaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 555 - RNA, 1931 nt, synthetic construct
  misc_feature 1..1931: note = mRNA product Design b-2 comprising derived and/or modified sequence from HRSV(A2)__F-del (opt11)
  source 1..1931: mol_type = other RNA
gggagagcctctgctggagtccggggagtggcgttggctgctagagcgaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 556 - RNA, 1951 nt, synthetic construct
  misc_feature 1..1951: note = mRNA product Design b-3 comprising derived and/or modified sequence from HRSV(A2)__F-del (artificial)
  source 1..1951: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 557 - RNA, 1951 nt, synthetic construct
  misc_feature 1..1951: note = mRNA product Design b-3 comprising derived and/or modified sequence from HRSV(A2)__F-del (opt1)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 558 - RNA, 1951 nt, synthetic construct
  misc_feature 1..1951: note = mRNA product Design b-3 comprising derived and/or modified sequence from HRSV(A2)__F-del (opt1)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 559 - RNA, 1951 nt, synthetic construct
  misc_feature 1..1951: note = mRNA product Design b-3 comprising derived and/or modified sequence from HRSV(A2)__F-del (opt2)
  source 1..1951: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 560 - RNA, 1951 nt, synthetic construct
  misc_feature 1..1951: note = mRNA product Design b-3 comprising derived and/or modified sequence from HRSV(A2)__F-del (opt3)
  source 1..1951: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 561 - RNA, 1951 nt, synthetic construct
  misc_feature 1..1951: note = mRNA product Design b-3 comprising derived and/or modified sequence from HRSV(A2)__F-del (opt4)
  source 1..1951: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 562 - RNA, 1951 nt, synthetic construct
  misc_feature 1..1951: note = mRNA product Design b-3 comprising derived and/or modified sequence from HRSV(A2)__F-del (opt5)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 563 - RNA, 1951 nt, synthetic construct
  misc_feature 1..1951: note = mRNA product Design b-3 comprising derived and/or modified sequence from HRSV(A2)__F-del (opt6)
  source 1..1951: mol_type = other RNA
gggagagtcccgcagtcggcgtccagcggctctgcttgttcgtgtgtgtgtcgttgcaggccttattcaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 564 - RNA, 1951 nt, synthetic construct
  misc_feature 1..1951: note = mRNA product Design b-3 comprising derived and/or modified sequence from HRSV(A2)__F-del (opt11)
  source 1..1951: mol_type = other RNA
gggagagtcccgcagtcggcgtccagcggctctgcttgttcgtgtgtgtgtcgttgcaggccttattcaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 565 - RNA, 2002 nt, synthetic construct
  misc_feature 1..2002: note = mRNA product Design b-4 comprising derived and/or modified sequence from HRSV(A2)__F-del (artificial)
  source 1..2002: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 566 - RNA, 2002 nt, synthetic construct
  misc_feature 1..2002: note = mRNA product Design b-4 comprising derived and/or modified sequence from HRSV(A2)__F-del (opt1)
  source 1..2002: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 567 - RNA, 2002 nt, synthetic construct
  misc_feature 1..2002: note = mRNA product Design b-4 comprising derived and/or modified sequence from HRSV(A2)__F-del (opt1)
  source 1..2002: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 568 - RNA, 2002 nt, synthetic construct
  misc_feature 1..2002: note = mRNA product Design b-4 comprising derived and/or modified sequence from HRSV(A2)__F-del (opt2)
  source 1..2002: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 569 - RNA, 2002 nt, synthetic construct
  misc_feature 1..2002: note = mRNA product Design b-4 comprising derived and/or modified sequence from HRSV(A2)__F-del (opt3)
  source 1..2002: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 570 - RNA, 2002 nt, synthetic construct
  misc_feature 1..2002: note = mRNA product Design b-4 comprising derived and/or modified sequence from HRSV(A2)__F-del (opt4)
  source 1..2002: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 571 - RNA, 2002 nt, synthetic construct
  misc_feature 1..2002: note = mRNA product Design b-4 comprising derived and/or modified sequence from HRSV(A2)__F-del (opt5)
  source 1..2002: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 572 - RNA, 2002 nt, synthetic construct
  misc_feature 1..2002: note = mRNA product Design b-4 comprising derived and/or modified sequence from HRSV(A2)__F-del (opt6)
  source 1..2002: mol_type = other RNA
gggagagtcccgcagtcggcgtccagcggctctgcttgttcgtgtgtgtgtcgttgcaggccttattcaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 573 - RNA, 2002 nt, synthetic construct
  misc_feature 1..2002: note = mRNA product Design b-4 comprising derived and/or modified sequence from HRSV(A2)__F-del (opt11)
  source 1..2002: mol_type = other RNA
gggagagtcccgcagtcggcgtccagcggctctgcttgttcgtgtgtgtgtcgttgcaggccttattcaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 574 - RNA, 2064 nt, synthetic construct
  misc_feature 1..2064: note = mRNA product Design b-5 comprising derived and/or modified sequence from HRSV(A2)__F-del (artificial)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 575 - RNA, 2064 nt, synthetic construct
  misc_feature 1..2064: note = mRNA product Design b-5 comprising derived and/or modified sequence from HRSV(A2)__F-del (opt1)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 576 - RNA, 2064 nt, synthetic construct
  misc_feature 1..2064: note = mRNA product Design b-5 comprising derived and/or modified sequence from HRSV(A2)__F-del (opt1)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 577 - RNA, 2064 nt, synthetic construct
  misc_feature 1..2064: note = mRNA product Design b-5 comprising derived and/or modified sequence from HRSV(A2)__F-del (opt2)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 578 - RNA, 2064 nt, synthetic construct
  misc_feature 1..2064: note = mRNA product Design b-5 comprising derived and/or modified sequence from HRSV(A2)__F-del (opt3)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 579 - RNA, 2064 nt, synthetic construct
  misc_feature 1..2064: note = mRNA product Design b-5 comprising derived and/or modified sequence from HRSV(A2)__F-del (opt4)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 580 - RNA, 2064 nt, synthetic construct
  misc_feature 1..2064: note = mRNA product Design b-5 comprising derived and/or modified sequence from HRSV(A2)__F-del (opt5)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 581 - RNA, 2064 nt, synthetic construct
  misc_feature 1..2064: note = mRNA product Design b-5 comprising derived and/or modified sequence from HRSV(A2)__F-del (opt6)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 582 - RNA, 2064 nt, synthetic construct
  misc_feature 1..2064: note = mRNA product Design b-5 comprising derived and/or modified sequence from HRSV(A2)__F-del (opt11)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 583 - RNA, 1970 nt, synthetic construct
  misc_feature 1..1970: note = mRNA product Design c-1 comprising derived and/or modified sequence from HRSV(A2)__F-del (artificial)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 584 - RNA, 1970 nt, synthetic construct
  misc_feature 1..1970: note = mRNA product Design c-1 comprising derived and/or modified sequence from HRSV(A2)__F-del (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 585 - RNA, 1970 nt, synthetic construct
  misc_feature 1..1970: note = mRNA product Design c-1 comprising derived and/or modified sequence from HRSV(A2)__F-del (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 586 - RNA, 1970 nt, synthetic construct
  misc_feature 1..1970: note = mRNA product Design c-1 comprising derived and/or modified sequence from HRSV(A2)__F-del (opt2)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 587 - RNA, 1970 nt, synthetic construct
  misc_feature 1..1970: note = mRNA product Design c-1 comprising derived and/or modified sequence from HRSV(A2)__F-del (opt3)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 588 - RNA, 1970 nt, synthetic construct
  misc_feature 1..1970: note = mRNA product Design c-1 comprising derived and/or modified sequence from HRSV(A2)__F-del (opt4)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 589 - RNA, 1970 nt, synthetic construct
  misc_feature 1..1970: note = mRNA product Design c-1 comprising derived and/or modified sequence from HRSV(A2)__F-del (opt5)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 590 - RNA, 1970 nt, synthetic construct
  misc_feature 1..1970: note = mRNA product Design c-1 comprising derived and/or modified sequence from HRSV(A2)__F-del (opt6)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 591 - RNA, 1970 nt, synthetic construct
  misc_feature 1..1970: note = mRNA product Design c-1 comprising derived and/or modified sequence from HRSV(A2)__F-del (opt11)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 592 - RNA, 2060 nt, synthetic construct
  misc_feature 1..2060: note = mRNA product Design c-2 comprising derived and/or modified sequence from HRSV(A2)__F-del (artificial)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 593 - RNA, 2060 nt, synthetic construct
  misc_feature 1..2060: note = mRNA product Design c-2 comprising derived and/or modified sequence from HRSV(A2)__F-del (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 594 - RNA, 2060 nt, synthetic construct
  misc_feature 1..2060: note = mRNA product Design c-2 comprising derived and/or modified sequence from HRSV(A2)__F-del (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 595 - RNA, 2060 nt, synthetic construct
  misc_feature 1..2060: note = mRNA product Design c-2 comprising derived and/or modified sequence from HRSV(A2)__F-del (opt2)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 596 - RNA, 2060 nt, synthetic construct
  misc_feature 1..2060: note = mRNA product Design c-2 comprising derived and/or modified sequence from HRSV(A2)__F-del (opt3)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 597 - RNA, 2060 nt, synthetic construct
  misc_feature 1..2060: note = mRNA product Design c-2 comprising derived and/or modified sequence from HRSV(A2)__F-del (opt4)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 598 - RNA, 2060 nt, synthetic construct
  misc_feature 1..2060: note = mRNA product Design c-2 comprising derived and/or modified sequence from HRSV(A2)__F-del (opt5)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 599 - RNA, 2060 nt, synthetic construct
  misc_feature 1..2060: note = mRNA product Design c-2 comprising derived and/or modified sequence from HRSV(A2)__F-del (opt6)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 600 - RNA, 2060 nt, synthetic construct
  misc_feature 1..2060: note = mRNA product Design c-2 comprising derived and/or modified sequence from HRSV(A2)__F-del (opt11)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 601 - RNA, 2037 nt, synthetic construct
  misc_feature 1..2037: note = mRNA product Design c-3 comprising derived and/or modified sequence from HRSV(A2)__F-del (artificial)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 602 - RNA, 2037 nt, synthetic construct
  misc_feature 1..2037: note = mRNA product Design c-3 comprising derived and/or modified sequence from HRSV(A2)__F-del (opt1)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 603 - RNA, 2037 nt, synthetic construct
  misc_feature 1..2037: note = mRNA product Design c-3 comprising derived and/or modified sequence from HRSV(A2)__F-del (opt1)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 604 - RNA, 2037 nt, synthetic construct
  misc_feature 1..2037: note = mRNA product Design c-3 comprising derived and/or modified sequence from HRSV(A2)__F-del (opt2)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 605 - RNA, 2037 nt, synthetic construct
  misc_feature 1..2037: note = mRNA product Design c-3 comprising derived and/or modified sequence from HRSV(A2)__F-del (opt3)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 606 - RNA, 2037 nt, synthetic construct
  misc_feature 1..2037: note = mRNA product Design c-3 comprising derived and/or modified sequence from HRSV(A2)__F-del (opt4)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 607 - RNA, 2037 nt, synthetic construct
  misc_feature 1..2037: note = mRNA product Design c-3 comprising derived and/or modified sequence from HRSV(A2)__F-del (opt5)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 608 - RNA, 2037 nt, synthetic construct
  misc_feature 1..2037: note = mRNA product Design c-3 comprising derived and/or modified sequence from HRSV(A2)__F-del (opt6)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 609 - RNA, 2037 nt, synthetic construct
  misc_feature 1..2037: note = mRNA product Design c-3 comprising derived and/or modified sequence from HRSV(A2)__F-del (opt11)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 610 - RNA, 2033 nt, synthetic construct
  misc_feature 1..2033: note = mRNA product Design c-4 comprising derived and/or modified sequence from HRSV(A2)__F-del (artificial)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 611 - RNA, 2033 nt, synthetic construct
  misc_feature 1..2033: note = mRNA product Design c-4 comprising derived and/or modified sequence from HRSV(A2)__F-del (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 612 - RNA, 2033 nt, synthetic construct
  misc_feature 1..2033: note = mRNA product Design c-4 comprising derived and/or modified sequence from HRSV(A2)__F-del (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 613 - RNA, 2033 nt, synthetic construct
  misc_feature 1..2033: note = mRNA product Design c-4 comprising derived and/or modified sequence from HRSV(A2)__F-del (opt2)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 614 - RNA, 2033 nt, synthetic construct
  misc_feature 1..2033: note = mRNA product Design c-4 comprising derived and/or modified sequence from HRSV(A2)__F-del (opt3)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 615 - RNA, 2033 nt, synthetic construct
  misc_feature 1..2033: note = mRNA product Design c-4 comprising derived and/or modified sequence from HRSV(A2)__F-del (opt4)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 616 - RNA, 2033 nt, synthetic construct
  misc_feature 1..2033: note = mRNA product Design c-4 comprising derived and/or modified sequence from HRSV(A2)__F-del (opt5)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 617 - RNA, 2033 nt, synthetic construct
  misc_feature 1..2033: note = mRNA product Design c-4 comprising derived and/or modified sequence from HRSV(A2)__F-del (opt6)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 618 - RNA, 2033 nt, synthetic construct
  misc_feature 1..2033: note = mRNA product Design c-4 comprising derived and/or modified sequence from HRSV(A2)__F-del (opt11)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 619 - RNA, 1951 nt, synthetic construct
  misc_feature 1..1951: note = mRNA product Design c-5 comprising derived and/or modified sequence from HRSV(A2)__F-del (artificial)
  source 1..1951: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 620 - RNA, 1951 nt, synthetic construct
  misc_feature 1..1951: note = mRNA product Design c-5 comprising derived and/or modified sequence from HRSV(A2)__F-del (opt1)
  source 1..1951: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 621 - RNA, 1951 nt, synthetic construct
  misc_feature 1..1951: note = mRNA product Design c-5 comprising derived and/or modified sequence from HRSV(A2)__F-del (opt1)
  source 1..1951: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 622 - RNA, 1951 nt, synthetic construct
  misc_feature 1..1951: note = mRNA product Design c-5 comprising derived and/or modified sequence from HRSV(A2)__F-del (opt2)
  source 1..1951: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 623 - RNA, 1951 nt, synthetic construct
  misc_feature 1..1951: note = mRNA product Design c-5 comprising derived and/or modified sequence from HRSV(A2)__F-del (opt3)
  source 1..1951: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 624 - RNA, 1951 nt, synthetic construct
  misc_feature 1..1951: note = mRNA product Design c-5 comprising derived and/or modified sequence from HRSV(A2)__F-del (opt4)
  source 1..1951: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 625 - RNA, 1951 nt, synthetic construct
  misc_feature 1..1951: note = mRNA product Design c-5 comprising derived and/or modified sequence from HRSV(A2)__F-del (opt5)
  source 1..1951: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 626 - RNA, 1951 nt, synthetic construct
  misc_feature 1..1951: note = mRNA product Design c-5 comprising derived and/or modified sequence from HRSV(A2)__F-del (opt6)
  source 1..1951: mol_type = other RNA
gggagagcggctcggccattttgtcccagtcagtccggaggctgcggctgcagaagtaccgcctgcggagtaactgcaaagaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 627 - RNA, 1951 nt, synthetic construct
  misc_feature 1..1951: note = mRNA product Design c-5 comprising derived and/or modified sequence from HRSV(A2)__F-del (opt11)
  source 1..1951: mol_type = other RNA
gggagagcggctcggccattttgtcccagtcagtccggaggctgcggctgcagaagtaccgcctgcggagtaactgcaaagaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 628 - RNA, 1960 nt, synthetic construct
  misc_feature 1..1960: note = mRNA product Design d-1 comprising derived and/or modified sequence from HRSV(A2)__F-del (artificial)
  source 1..1960: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 629 - RNA, 1960 nt, synthetic construct
  misc_feature 1..1960: note = mRNA product Design d-1 comprising derived and/or modified sequence from HRSV(A2)__F-del (opt1)
  source 1..1960: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 630 - RNA, 1960 nt, synthetic construct
  misc_feature 1..1960: note = mRNA product Design d-1 comprising derived and/or modified sequence from HRSV(A2)__F-del (opt1)
  source 1..1960: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 631 - RNA, 1960 nt, synthetic construct
  misc_feature 1..1960: note = mRNA product Design d-1 comprising derived and/or modified sequence from HRSV(A2)__F-del (opt2)
  source 1..1960: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 632 - RNA, 1960 nt, synthetic construct
  misc_feature 1..1960: note = mRNA product Design d-1 comprising derived and/or modified sequence from HRSV(A2)__F-del (opt3)
  source 1..1960: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 633 - RNA, 1960 nt, synthetic construct
  misc_feature 1..1960: note = mRNA product Design d-1 comprising derived and/or modified sequence from HRSV(A2)__F-del (opt4)
  source 1..1960: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 634 - RNA, 1960 nt, synthetic construct
  misc_feature 1..1960: note = mRNA product Design d-1 comprising derived and/or modified sequence from HRSV(A2)__F-del (opt5)
  source 1..1960: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 635 - RNA, 1960 nt, synthetic construct
  misc_feature 1..1960: note = mRNA product Design d-1 comprising derived and/or modified sequence from HRSV(A2)__F-del (opt6)
  source 1..1960: mol_type = other RNA
gggagacccgtgacccggaagttgtacggctacgcgactttccctcccacaaaccctcgcgcccttcctttcctacttgggcccggcagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 636 - RNA, 1960 nt, synthetic construct
  misc_feature 1..1960: note = mRNA product Design d-1 comprising derived and/or modified sequence from HRSV(A2)__F-del (opt11)
  source 1..1960: mol_type = other RNA
gggagacccgtgacccggaagttgtacggctacgcgactttccctcccacaaaccctcgcgcccttcctttcctacttgggcccggcagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 637 - RNA, 2015 nt, synthetic construct
  misc_feature 1..2015: note = mRNA product Design d-2 comprising derived and/or modified sequence from HRSV(A2)__F-del (artificial)
  source 1..2015: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 638 - RNA, 2015 nt, synthetic construct
  misc_feature 1..2015: note = mRNA product Design d-2 comprising derived and/or modified sequence from HRSV(A2)__F-del (opt1)
  source 1..2015: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 639 - RNA, 2015 nt, synthetic construct
  misc_feature 1..2015: note = mRNA product Design d-2 comprising derived and/or modified sequence from HRSV(A2)__F-del (opt1)
  source 1..2015: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 640 - RNA, 2015 nt, synthetic construct
  misc_feature 1..2015: note = mRNA product Design d-2 comprising derived and/or modified sequence from HRSV(A2)__F-del (opt2)
  source 1..2015: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 641 - RNA, 2015 nt, synthetic construct
  misc_feature 1..2015: note = mRNA product Design d-2 comprising derived and/or modified sequence from HRSV(A2)__F-del (opt3)
  source 1..2015: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 642 - RNA, 2015 nt, synthetic construct
  misc_feature 1..2015: note = mRNA product Design d-2 comprising derived and/or modified sequence from HRSV(A2)__F-del (opt4)
  source 1..2015: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 643 - RNA, 2015 nt, synthetic construct
  misc_feature 1..2015: note = mRNA product Design d-2 comprising derived and/or modified sequence from HRSV(A2)__F-del (opt5)
  source 1..2015: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 644 - RNA, 2015 nt, synthetic construct
  misc_feature 1..2015: note = mRNA product Design d-2 comprising derived and/or modified sequence from HRSV(A2)__F-del (opt6)
  source 1..2015: mol_type = other RNA
gggagagcggctcggccattttgtcccagtcagtccggaggctgcggctgcagaagtaccgcctgcggagtaactgcaaagaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 645 - RNA, 2015 nt, synthetic construct
  misc_feature 1..2015: note = mRNA product Design d-2 comprising derived and/or modified sequence from HRSV(A2)__F-del (opt11)
  source 1..2015: mol_type = other RNA
gggagagcggctcggccattttgtcccagtcagtccggaggctgcggctgcagaagtaccgcctgcggagtaactgcaaagaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 646 - RNA, 2331 nt, synthetic construct
  misc_feature 1..2331: note = mRNA product Design d-3 comprising derived and/or modified sequence from HRSV(A2)__F-del (artificial)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 647 - RNA, 2331 nt, synthetic construct
  misc_feature 1..2331: note = mRNA product Design d-3 comprising derived and/or modified sequence from HRSV(A2)__F-del (opt1)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 648 - RNA, 2331 nt, synthetic construct
  misc_feature 1..2331: note = mRNA product Design d-3 comprising derived and/or modified sequence from HRSV(A2)__F-del (opt1)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 649 - RNA, 2331 nt, synthetic construct
  misc_feature 1..2331: note = mRNA product Design d-3 comprising derived and/or modified sequence from HRSV(A2)__F-del (opt2)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 650 - RNA, 2331 nt, synthetic construct
  misc_feature 1..2331: note = mRNA product Design d-3 comprising derived and/or modified sequence from HRSV(A2)__F-del (opt3)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 651 - RNA, 2331 nt, synthetic construct
  misc_feature 1..2331: note = mRNA product Design d-3 comprising derived and/or modified sequence from HRSV(A2)__F-del (opt4)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 652 - RNA, 2331 nt, synthetic construct
  misc_feature 1..2331: note = mRNA product Design d-3 comprising derived and/or modified sequence from HRSV(A2)__F-del (opt5)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 653 - RNA, 2331 nt, synthetic construct
  misc_feature 1..2331: note = mRNA product Design d-3 comprising derived and/or modified sequence from HRSV(A2)__F-del (opt6)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 654 - RNA, 2331 nt, synthetic construct
  misc_feature 1..2331: note = mRNA product Design d-3 comprising derived and/or modified sequence from HRSV(A2)__F-del (opt11)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 655 - RNA, 2014 nt, synthetic construct
  misc_feature 1..2014: note = mRNA product Design d-4 comprising derived and/or modified sequence from HRSV(A2)__F-del (artificial)
  source 1..2014: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 656 - RNA, 2014 nt, synthetic construct
  misc_feature 1..2014: note = mRNA product Design d-4 comprising derived and/or modified sequence from HRSV(A2)__F-del (opt1)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 657 - RNA, 2014 nt, synthetic construct
  misc_feature 1..2014: note = mRNA product Design d-4 comprising derived and/or modified sequence from HRSV(A2)__F-del (opt1)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 658 - RNA, 2014 nt, synthetic construct
  misc_feature 1..2014: note = mRNA product Design d-4 comprising derived and/or modified sequence from HRSV(A2)__F-del (opt2)
  source 1..2014: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 659 - RNA, 2014 nt, synthetic construct
  misc_feature 1..2014: note = mRNA product Design d-4 comprising derived and/or modified sequence from HRSV(A2)__F-del (opt3)
  source 1..2014: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 660 - RNA, 2014 nt, synthetic construct
  misc_feature 1..2014: note = mRNA product Design d-4 comprising derived and/or modified sequence from HRSV(A2)__F-del (opt4)
  source 1..2014: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 661 - RNA, 2014 nt, synthetic construct
  misc_feature 1..2014: note = mRNA product Design d-4 comprising derived and/or modified sequence from HRSV(A2)__F-del (opt5)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 662 - RNA, 2014 nt, synthetic construct
  misc_feature 1..2014: note = mRNA product Design d-4 comprising derived and/or modified sequence from HRSV(A2)__F-del (opt6)
  source 1..2014: mol_type = other RNA
gggagagtcccgcagtcggcgtccagcggctctgcttgttcgtgtgtgtgtcgttgcaggccttattcaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 663 - RNA, 2014 nt, synthetic construct
  misc_feature 1..2014: note = mRNA product Design d-4 comprising derived and/or modified sequence from HRSV(A2)__F-del (opt11)
  source 1..2014: mol_type = other RNA
gggagagtcccgcagtcggcgtccagcggctctgcttgttcgtgtgtgtgtcgttgcaggccttattcaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 664 - RNA, 2111 nt, synthetic construct
  misc_feature 1..2111: note = mRNA product Design d-5 comprising derived and/or modified sequence from HRSV(A2)__F-del (artificial)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 665 - RNA, 2111 nt, synthetic construct
  misc_feature 1..2111: note = mRNA product Design d-5 comprising derived and/or modified sequence from HRSV(A2)__F-del (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 666 - RNA, 2111 nt, synthetic construct
  misc_feature 1..2111: note = mRNA product Design d-5 comprising derived and/or modified sequence from HRSV(A2)__F-del (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 667 - RNA, 2111 nt, synthetic construct
  misc_feature 1..2111: note = mRNA product Design d-5 comprising derived and/or modified sequence from HRSV(A2)__F-del (opt2)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 668 - RNA, 2111 nt, synthetic construct
  misc_feature 1..2111: note = mRNA product Design d-5 comprising derived and/or modified sequence from HRSV(A2)__F-del (opt3)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 669 - RNA, 2111 nt, synthetic construct
  misc_feature 1..2111: note = mRNA product Design d-5 comprising derived and/or modified sequence from HRSV(A2)__F-del (opt4)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 670 - RNA, 2111 nt, synthetic construct
  misc_feature 1..2111: note = mRNA product Design d-5 comprising derived and/or modified sequence from HRSV(A2)__F-del (opt5)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 671 - RNA, 2111 nt, synthetic construct
  misc_feature 1..2111: note = mRNA product Design d-5 comprising derived and/or modified sequence from HRSV(A2)__F-del (opt6)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 672 - RNA, 2111 nt, synthetic construct
  misc_feature 1..2111: note = mRNA product Design d-5 comprising derived and/or modified sequence from HRSV(A2)__F-del (opt11)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 673 - RNA, 1991 nt, synthetic construct
  misc_feature 1..1991: note = mRNA product Design e-1 comprising derived and/or modified sequence from HRSV(A2)__F-del (artificial)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 674 - RNA, 1991 nt, synthetic construct
  misc_feature 1..1991: note = mRNA product Design e-1 comprising derived and/or modified sequence from HRSV(A2)__F-del (opt1)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 675 - RNA, 1991 nt, synthetic construct
  misc_feature 1..1991: note = mRNA product Design e-1 comprising derived and/or modified sequence from HRSV(A2)__F-del (opt1)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 676 - RNA, 1991 nt, synthetic construct
  misc_feature 1..1991: note = mRNA product Design e-1 comprising derived and/or modified sequence from HRSV(A2)__F-del (opt2)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 677 - RNA, 1991 nt, synthetic construct
  misc_feature 1..1991: note = mRNA product Design e-1 comprising derived and/or modified sequence from HRSV(A2)__F-del (opt3)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 678 - RNA, 1991 nt, synthetic construct
  misc_feature 1..1991: note = mRNA product Design e-1 comprising derived and/or modified sequence from HRSV(A2)__F-del (opt4)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 679 - RNA, 1991 nt, synthetic construct
  misc_feature 1..1991: note = mRNA product Design e-1 comprising derived and/or modified sequence from HRSV(A2)__F-del (opt5)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 680 - RNA, 1991 nt, synthetic construct
  misc_feature 1..1991: note = mRNA product Design e-1 comprising derived and/or modified sequence from HRSV(A2)__F-del (opt6)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 681 - RNA, 1991 nt, synthetic construct
  misc_feature 1..1991: note = mRNA product Design e-1 comprising derived and/or modified sequence from HRSV(A2)__F-del (opt11)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 682 - RNA, 1973 nt, synthetic construct
  misc_feature 1..1973: note = mRNA product Design e-2 comprising derived and/or modified sequence from HRSV(A2)__F-del (artificial)
  source 1..1973: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 683 - RNA, 1973 nt, synthetic construct
  misc_feature 1..1973: note = mRNA product Design e-2 comprising derived and/or modified sequence from HRSV(A2)__F-del (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 684 - RNA, 1973 nt, synthetic construct
  misc_feature 1..1973: note = mRNA product Design e-2 comprising derived and/or modified sequence from HRSV(A2)__F-del (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 685 - RNA, 1973 nt, synthetic construct
  misc_feature 1..1973: note = mRNA product Design e-2 comprising derived and/or modified sequence from HRSV(A2)__F-del (opt2)
  source 1..1973: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 686 - RNA, 1973 nt, synthetic construct
  misc_feature 1..1973: note = mRNA product Design e-2 comprising derived and/or modified sequence from HRSV(A2)__F-del (opt3)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 687 - RNA, 1973 nt, synthetic construct
  misc_feature 1..1973: note = mRNA product Design e-2 comprising derived and/or modified sequence from HRSV(A2)__F-del (opt4)
  source 1..1973: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 688 - RNA, 1973 nt, synthetic construct
  misc_feature 1..1973: note = mRNA product Design e-2 comprising derived and/or modified sequence from HRSV(A2)__F-del (opt5)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 689 - RNA, 1973 nt, synthetic construct
  misc_feature 1..1973: note = mRNA product Design e-2 comprising derived and/or modified sequence from HRSV(A2)__F-del (opt6)
  source 1..1973: mol_type = other RNA
gggagacccgtgacccggaagttgtacggctacgcgactttccctcccacaaaccctcgcgcccttcctttcctacttgggcccggcagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 690 - RNA, 1973 nt, synthetic construct
  misc_feature 1..1973: note = mRNA product Design e-2 comprising derived and/or modified sequence from HRSV(A2)__F-del (opt11)
  source 1..1973: mol_type = other RNA
gggagacccgtgacccggaagttgtacggctacgcgactttccctcccacaaaccctcgcgcccttcctttcctacttgggcccggcagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 691 - RNA, 1943 nt, synthetic construct
  misc_feature 1..1943: note = mRNA product Design e-3 comprising derived and/or modified sequence from HRSV(A2)__F-del (artificial)
  source 1..1943: mol_type = other RNA
gggagactttcccattctgtagcagaatttggtgttgcctgtggtcttggtcccgcggagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 692 - RNA, 1943 nt, synthetic construct
  misc_feature 1..1943: note = mRNA product Design e-3 comprising derived and/or modified sequence from HRSV(A2)__F-del (opt1)
  source 1..1943: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 693 - RNA, 1943 nt, synthetic construct
  misc_feature 1..1943: note = mRNA product Design e-3 comprising derived and/or modified sequence from HRSV(A2)__F-del (opt1)
  source 1..1943: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 694 - RNA, 1943 nt, synthetic construct
  misc_feature 1..1943: note = mRNA product Design e-3 comprising derived and/or modified sequence from HRSV(A2)__F-del (opt2)
  source 1..1943: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 695 - RNA, 1943 nt, synthetic construct
  misc_feature 1..1943: note = mRNA product Design e-3 comprising derived and/or modified sequence from HRSV(A2)__F-del (opt3)
  source 1..1943: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 696 - RNA, 1943 nt, synthetic construct
  misc_feature 1..1943: note = mRNA product Design e-3 comprising derived and/or modified sequence from HRSV(A2)__F-del (opt4)
  source 1..1943: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 697 - RNA, 1943 nt, synthetic construct
  misc_feature 1..1943: note = mRNA product Design e-3 comprising derived and/or modified sequence from HRSV(A2)__F-del (opt5)
  source 1..1943: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 698 - RNA, 1943 nt, synthetic construct
  misc_feature 1..1943: note = mRNA product Design e-3 comprising derived and/or modified sequence from HRSV(A2)__F-del (opt6)
  source 1..1943: mol_type = other RNA
gggagactttcccattctgtagcagaatttggtgttgcctgtggtcttggtcccgcggagaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 699 - RNA, 1943 nt, synthetic construct
  misc_feature 1..1943: note = mRNA product Design e-3 comprising derived and/or modified sequence from HRSV(A2)__F-del (opt11)
  source 1..1943: mol_type = other RNA
gggagactttcccattctgtagcagaatttggtgttgcctgtggtcttggtcccgcggagaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 700 - RNA, 1997 nt, synthetic construct
  misc_feature 1..1997: note = mRNA product Design e-4 comprising derived and/or modified sequence from HRSV(A2)__F-del (artificial)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 701 - RNA, 1997 nt, synthetic construct
  misc_feature 1..1997: note = mRNA product Design e-4 comprising derived and/or modified sequence from HRSV(A2)__F-del (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 702 - RNA, 1997 nt, synthetic construct
  misc_feature 1..1997: note = mRNA product Design e-4 comprising derived and/or modified sequence from HRSV(A2)__F-del (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 703 - RNA, 1997 nt, synthetic construct
  misc_feature 1..1997: note = mRNA product Design e-4 comprising derived and/or modified sequence from HRSV(A2)__F-del (opt2)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 704 - RNA, 1997 nt, synthetic construct
  misc_feature 1..1997: note = mRNA product Design e-4 comprising derived and/or modified sequence from HRSV(A2)__F-del (opt3)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 705 - RNA, 1997 nt, synthetic construct
  misc_feature 1..1997: note = mRNA product Design e-4 comprising derived and/or modified sequence from HRSV(A2)__F-del (opt4)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 706 - RNA, 1997 nt, synthetic construct
  misc_feature 1..1997: note = mRNA product Design e-4 comprising derived and/or modified sequence from HRSV(A2)__F-del (opt5)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 707 - RNA, 1997 nt, synthetic construct
  misc_feature 1..1997: note = mRNA product Design e-4 comprising derived and/or modified sequence from HRSV(A2)__F-del (opt6)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 708 - RNA, 1997 nt, synthetic construct
  misc_feature 1..1997: note = mRNA product Design e-4 comprising derived and/or modified sequence from HRSV(A2)__F-del (opt11)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 709 - RNA, 1964 nt, synthetic construct
  misc_feature 1..1964: note = mRNA product Design e-5 comprising derived and/or modified sequence from HRSV(A2)__F-del (artificial)
  source 1..1964: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 710 - RNA, 1964 nt, synthetic construct
  misc_feature 1..1964: note = mRNA product Design e-5 comprising derived and/or modified sequence from HRSV(A2)__F-del (opt1)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 711 - RNA, 1964 nt, synthetic construct
  misc_feature 1..1964: note = mRNA product Design e-5 comprising derived and/or modified sequence from HRSV(A2)__F-del (opt1)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 712 - RNA, 1964 nt, synthetic construct
  misc_feature 1..1964: note = mRNA product Design e-5 comprising derived and/or modified sequence from HRSV(A2)__F-del (opt2)
  source 1..1964: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 713 - RNA, 1964 nt, synthetic construct
  misc_feature 1..1964: note = mRNA product Design e-5 comprising derived and/or modified sequence from HRSV(A2)__F-del (opt3)
  source 1..1964: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 714 - RNA, 1964 nt, synthetic construct
  misc_feature 1..1964: note = mRNA product Design e-5 comprising derived and/or modified sequence from HRSV(A2)__F-del (opt4)
  source 1..1964: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 715 - RNA, 1964 nt, synthetic construct
  misc_feature 1..1964: note = mRNA product Design e-5 comprising derived and/or modified sequence from HRSV(A2)__F-del (opt5)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 716 - RNA, 1964 nt, synthetic construct
  misc_feature 1..1964: note = mRNA product Design e-5 comprising derived and/or modified sequence from HRSV(A2)__F-del (opt6)
  source 1..1964: mol_type = other RNA
gggagagcggctcggccattttgtcccagtcagtccggaggctgcggctgcagaagtaccgcctgcggagtaactgcaaagaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 717 - RNA, 1964 nt, synthetic construct
  misc_feature 1..1964: note = mRNA product Design e-5 comprising derived and/or modified sequence from HRSV(A2)__F-del (opt11)
  source 1..1964: mol_type = other RNA
gggagagcggctcggccattttgtcccagtcagtccggaggctgcggctgcagaagtaccgcctgcggagtaactgcaaagaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 718 - RNA, 2031 nt, synthetic construct
  misc_feature 1..2031: note = mRNA product Design e-6 comprising derived and/or modified sequence from HRSV(A2)__F-del (artificial)
  source 1..2031: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 719 - RNA, 2031 nt, synthetic construct
  misc_feature 1..2031: note = mRNA product Design e-6 comprising derived and/or modified sequence from HRSV(A2)__F-del (opt1)
  source 1..2031: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 720 - RNA, 2031 nt, synthetic construct
  misc_feature 1..2031: note = mRNA product Design e-6 comprising derived and/or modified sequence from HRSV(A2)__F-del (opt1)
  source 1..2031: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 721 - RNA, 2031 nt, synthetic construct
  misc_feature 1..2031: note = mRNA product Design e-6 comprising derived and/or modified sequence from HRSV(A2)__F-del (opt2)
  source 1..2031: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 722 - RNA, 2031 nt, synthetic construct
  misc_feature 1..2031: note = mRNA product Design e-6 comprising derived and/or modified sequence from HRSV(A2)__F-del (opt3)
  source 1..2031: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 723 - RNA, 2031 nt, synthetic construct
  misc_feature 1..2031: note = mRNA product Design e-6 comprising derived and/or modified sequence from HRSV(A2)__F-del (opt4)
  source 1..2031: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 724 - RNA, 2031 nt, synthetic construct
  misc_feature 1..2031: note = mRNA product Design e-6 comprising derived and/or modified sequence from HRSV(A2)__F-del (opt5)
  source 1..2031: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 725 - RNA, 2031 nt, synthetic construct
  misc_feature 1..2031: note = mRNA product Design e-6 comprising derived and/or modified sequence from HRSV(A2)__F-del (opt6)
  source 1..2031: mol_type = other RNA
gggagagcggctcggccattttgtcccagtcagtccggaggctgcggctgcagaagtaccgcctgcggagtaactgcaaagaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 726 - RNA, 2031 nt, synthetic construct
  misc_feature 1..2031: note = mRNA product Design e-6 comprising derived and/or modified sequence from HRSV(A2)__F-del (opt11)
  source 1..2031: mol_type = other RNA
gggagagcggctcggccattttgtcccagtcagtccggaggctgcggctgcagaagtaccgcctgcggagtaactgcaaagaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 727 - RNA, 2247 nt, synthetic construct
  misc_feature 1..2247: note = mRNA product Design f-1 comprising derived and/or modified sequence from HRSV(A2)__F-del (artificial)
  source 1..2247: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 728 - RNA, 2247 nt, synthetic construct
  misc_feature 1..2247: note = mRNA product Design f-1 comprising derived and/or modified sequence from HRSV(A2)__F-del (opt1)
  source 1..2247: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 729 - RNA, 2247 nt, synthetic construct
  misc_feature 1..2247: note = mRNA product Design f-1 comprising derived and/or modified sequence from HRSV(A2)__F-del (opt1)
  source 1..2247: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 730 - RNA, 2247 nt, synthetic construct
  misc_feature 1..2247: note = mRNA product Design f-1 comprising derived and/or modified sequence from HRSV(A2)__F-del (opt2)
  source 1..2247: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 731 - RNA, 2247 nt, synthetic construct
  misc_feature 1..2247: note = mRNA product Design f-1 comprising derived and/or modified sequence from HRSV(A2)__F-del (opt3)
  source 1..2247: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 732 - RNA, 2247 nt, synthetic construct
  misc_feature 1..2247: note = mRNA product Design f-1 comprising derived and/or modified sequence from HRSV(A2)__F-del (opt4)
  source 1..2247: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 733 - RNA, 2247 nt, synthetic construct
  misc_feature 1..2247: note = mRNA product Design f-1 comprising derived and/or modified sequence from HRSV(A2)__F-del (opt5)
  source 1..2247: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 734 - RNA, 2247 nt, synthetic construct
  misc_feature 1..2247: note = mRNA product Design f-1 comprising derived and/or modified sequence from HRSV(A2)__F-del (opt6)
  source 1..2247: mol_type = other RNA
gggagagcggctcggccattttgtcccagtcagtccggaggctgcggctgcagaagtaccgcctgcggagtaactgcaaagaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 735 - RNA, 2247 nt, synthetic construct
  misc_feature 1..2247: note = mRNA product Design f-1 comprising derived and/or modified sequence from HRSV(A2)__F-del (opt11)
  source 1..2247: mol_type = other RNA
gggagagcggctcggccattttgtcccagtcagtccggaggctgcggctgcagaagtaccgcctgcggagtaactgcaaagaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 736 - RNA, 2027 nt, synthetic construct
  misc_feature 1..2027: note = mRNA product Design f-2 comprising derived and/or modified sequence from HRSV(A2)__F-del (artificial)
  source 1..2027: mol_type = other RNA
gggagagcggctcggccattttgtcccagtcagtccggaggctgcggctgcagaagtaccgcctgcggagtaactgcaaagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 737 - RNA, 2027 nt, synthetic construct
  misc_feature 1..2027: note = mRNA product Design f-2 comprising derived and/or modified sequence from HRSV(A2)__F-del (opt1)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 738 - RNA, 2027 nt, synthetic construct
  misc_feature 1..2027: note = mRNA product Design f-2 comprising derived and/or modified sequence from HRSV(A2)__F-del (opt1)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 739 - RNA, 2027 nt, synthetic construct
  misc_feature 1..2027: note = mRNA product Design f-2 comprising derived and/or modified sequence from HRSV(A2)__F-del (opt2)
  source 1..2027: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 740 - RNA, 2027 nt, synthetic construct
  misc_feature 1..2027: note = mRNA product Design f-2 comprising derived and/or modified sequence from HRSV(A2)__F-del (opt3)
  source 1..2027: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 741 - RNA, 2027 nt, synthetic construct
  misc_feature 1..2027: note = mRNA product Design f-2 comprising derived and/or modified sequence from HRSV(A2)__F-del (opt4)
  source 1..2027: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 742 - RNA, 2027 nt, synthetic construct
  misc_feature 1..2027: note = mRNA product Design f-2 comprising derived and/or modified sequence from HRSV(A2)__F-del (opt5)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 743 - RNA, 2027 nt, synthetic construct
  misc_feature 1..2027: note = mRNA product Design f-2 comprising derived and/or modified sequence from HRSV(A2)__F-del (opt6)
  source 1..2027: mol_type = other RNA
gggagagcggctcggccattttgtcccagtcagtccggaggctgcggctgcagaagtaccgcctgcggagtaactgcaaagaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 744 - RNA, 2027 nt, synthetic construct
  misc_feature 1..2027: note = mRNA product Design f-2 comprising derived and/or modified sequence from HRSV(A2)__F-del (opt11)
  source 1..2027: mol_type = other RNA
gggagagcggctcggccattttgtcccagtcagtccggaggctgcggctgcagaagtaccgcctgcggagtaactgcaaagaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 745 - RNA, 2018 nt, synthetic construct
  misc_feature 1..2018: note = mRNA product Design f-3 comprising derived and/or modified sequence from HRSV(A2)__F-del (artificial)
  source 1..2018: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 746 - RNA, 2018 nt, synthetic construct
  misc_feature 1..2018: note = mRNA product Design f-3 comprising derived and/or modified sequence from HRSV(A2)__F-del (opt1)
  source 1..2018: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 747 - RNA, 2018 nt, synthetic construct
  misc_feature 1..2018: note = mRNA product Design f-3 comprising derived and/or modified sequence from HRSV(A2)__F-del (opt1)
  source 1..2018: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 748 - RNA, 2018 nt, synthetic construct
  misc_feature 1..2018: note = mRNA product Design f-3 comprising derived and/or modified sequence from HRSV(A2)__F-del (opt2)
  source 1..2018: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 749 - RNA, 2018 nt, synthetic construct
  misc_feature 1..2018: note = mRNA product Design f-3 comprising derived and/or modified sequence from HRSV(A2)__F-del (opt3)
  source 1..2018: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 750 - RNA, 2018 nt, synthetic construct
  misc_feature 1..2018: note = mRNA product Design f-3 comprising derived and/or modified sequence from HRSV(A2)__F-del (opt4)
  source 1..2018: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 751 - RNA, 2018 nt, synthetic construct
  misc_feature 1..2018: note = mRNA product Design f-3 comprising derived and/or modified sequence from HRSV(A2)__F-del (opt5)
  source 1..2018: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 752 - RNA, 2018 nt, synthetic construct
  misc_feature 1..2018: note = mRNA product Design f-3 comprising derived and/or modified sequence from HRSV(A2)__F-del (opt6)
  source 1..2018: mol_type = other RNA
gggagagtcccgcagtcggcgtccagcggctctgcttgttcgtgtgtgtgtcgttgcaggccttattcaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 753 - RNA, 2018 nt, synthetic construct
  misc_feature 1..2018: note = mRNA product Design f-3 comprising derived and/or modified sequence from HRSV(A2)__F-del (opt11)
  source 1..2018: mol_type = other RNA
gggagagtcccgcagtcggcgtccagcggctctgcttgttcgtgtgtgtgtcgttgcaggccttattcaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 754 - RNA, 2234 nt, synthetic construct
  misc_feature 1..2234: note = mRNA product Design f-4 comprising derived and/or modified sequence from HRSV(A2)__F-del (artificial)
  source 1..2234: mol_type = other RNA
gggagagtcccgcagtcggcgtccagcggctctgcttgttcgtgtgtgtgtcgttgcaggccttattcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 755 - RNA, 2234 nt, synthetic construct
  misc_feature 1..2234: note = mRNA product Design f-4 comprising derived and/or modified sequence from HRSV(A2)__F-del (opt1)
  source 1..2234: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 756 - RNA, 2234 nt, synthetic construct
  misc_feature 1..2234: note = mRNA product Design f-4 comprising derived and/or modified sequence from HRSV(A2)__F-del (opt1)
  source 1..2234: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 757 - RNA, 2234 nt, synthetic construct
  misc_feature 1..2234: note = mRNA product Design f-4 comprising derived and/or modified sequence from HRSV(A2)__F-del (opt2)
  source 1..2234: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 758 - RNA, 2234 nt, synthetic construct
  misc_feature 1..2234: note = mRNA product Design f-4 comprising derived and/or modified sequence from HRSV(A2)__F-del (opt3)
  source 1..2234: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 759 - RNA, 2234 nt, synthetic construct
  misc_feature 1..2234: note = mRNA product Design f-4 comprising derived and/or modified sequence from HRSV(A2)__F-del (opt4)
  source 1..2234: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 760 - RNA, 2234 nt, synthetic construct
  misc_feature 1..2234: note = mRNA product Design f-4 comprising derived and/or modified sequence from HRSV(A2)__F-del (opt5)
  source 1..2234: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 761 - RNA, 2234 nt, synthetic construct
  misc_feature 1..2234: note = mRNA product Design f-4 comprising derived and/or modified sequence from HRSV(A2)__F-del (opt6)
  source 1..2234: mol_type = other RNA
gggagagtcccgcagtcggcgtccagcggctctgcttgttcgtgtgtgtgtcgttgcaggccttattcaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 762 - RNA, 2234 nt, synthetic construct
  misc_feature 1..2234: note = mRNA product Design f-4 comprising derived and/or modified sequence from HRSV(A2)__F-del (opt11)
  source 1..2234: mol_type = other RNA
gggagagtcccgcagtcggcgtccagcggctctgcttgttcgtgtgtgtgtcgttgcaggccttattcaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 763 - RNA, 2010 nt, synthetic construct
  misc_feature 1..2010: note = mRNA product Design f-5 comprising derived and/or modified sequence from HRSV(A2)__F-del (artificial)
  source 1..2010: mol_type = other RNA
gggagactttcccattctgtagcagaatttggtgttgcctgtggtcttggtcccgcggagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 764 - RNA, 2010 nt, synthetic construct
  misc_feature 1..2010: note = mRNA product Design f-5 comprising derived and/or modified sequence from HRSV(A2)__F-del (opt1)
  source 1..2010: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 765 - RNA, 2010 nt, synthetic construct
  misc_feature 1..2010: note = mRNA product Design f-5 comprising derived and/or modified sequence from HRSV(A2)__F-del (opt1)
  source 1..2010: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 766 - RNA, 2010 nt, synthetic construct
  misc_feature 1..2010: note = mRNA product Design f-5 comprising derived and/or modified sequence from HRSV(A2)__F-del (opt2)
  source 1..2010: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 767 - RNA, 2010 nt, synthetic construct
  misc_feature 1..2010: note = mRNA product Design f-5 comprising derived and/or modified sequence from HRSV(A2)__F-del (opt3)
  source 1..2010: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 768 - RNA, 2010 nt, synthetic construct
  misc_feature 1..2010: note = mRNA product Design f-5 comprising derived and/or modified sequence from HRSV(A2)__F-del (opt4)
  source 1..2010: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 769 - RNA, 2010 nt, synthetic construct
  misc_feature 1..2010: note = mRNA product Design f-5 comprising derived and/or modified sequence from HRSV(A2)__F-del (opt5)
  source 1..2010: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 770 - RNA, 2010 nt, synthetic construct
  misc_feature 1..2010: note = mRNA product Design f-5 comprising derived and/or modified sequence from HRSV(A2)__F-del (opt6)
  source 1..2010: mol_type = other RNA
gggagactttcccattctgtagcagaatttggtgttgcctgtggtcttggtcccgcggagaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 771 - RNA, 2010 nt, synthetic construct
  misc_feature 1..2010: note = mRNA product Design f-5 comprising derived and/or modified sequence from HRSV(A2)__F-del (opt11)
  source 1..2010: mol_type = other RNA
gggagactttcccattctgtagcagaatttggtgttgcctgtggtcttggtcccgcggagaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 772 - RNA, 2006 nt, synthetic construct
  misc_feature 1..2006: note = mRNA product Design g-1 comprising derived and/or modified sequence from HRSV(A2)__F-del (artificial)
  source 1..2006: mol_type = other RNA
gggagactttcccattctgtagcagaatttggtgttgcctgtggtcttggtcccgcggagaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 773 - RNA, 2006 nt, synthetic construct
  misc_feature 1..2006: note = mRNA product Design g-1 comprising derived and/or modified sequence from HRSV(A2)__F-del (opt1)
  source 1..2006: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 774 - RNA, 2006 nt, synthetic construct
  misc_feature 1..2006: note = mRNA product Design g-1 comprising derived and/or modified sequence from HRSV(A2)__F-del (opt1)
  source 1..2006: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 775 - RNA, 2006 nt, synthetic construct
  misc_feature 1..2006: note = mRNA product Design g-1 comprising derived and/or modified sequence from HRSV(A2)__F-del (opt2)
  source 1..2006: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 776 - RNA, 2006 nt, synthetic construct
  misc_feature 1..2006: note = mRNA product Design g-1 comprising derived and/or modified sequence from HRSV(A2)__F-del (opt3)
  source 1..2006: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 777 - RNA, 2006 nt, synthetic construct
  misc_feature 1..2006: note = mRNA product Design g-1 comprising derived and/or modified sequence from HRSV(A2)__F-del (opt4)
  source 1..2006: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 778 - RNA, 2006 nt, synthetic construct
  misc_feature 1..2006: note = mRNA product Design g-1 comprising derived and/or modified sequence from HRSV(A2)__F-del (opt5)
  source 1..2006: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 779 - RNA, 2006 nt, synthetic construct
  misc_feature 1..2006: note = mRNA product Design g-1 comprising derived and/or modified sequence from HRSV(A2)__F-del (opt6)
  source 1..2006: mol_type = other RNA
gggagactttcccattctgtagcagaatttggtgttgcctgtggtcttggtcccgcggagaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 780 - RNA, 2006 nt, synthetic construct
  misc_feature 1..2006: note = mRNA product Design g-1 comprising derived and/or modified sequence from HRSV(A2)__F-del (opt11)
  source 1..2006: mol_type = other RNA
gggagactttcccattctgtagcagaatttggtgttgcctgtggtcttggtcccgcggagaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 781 - RNA, 2021 nt, synthetic construct
  misc_feature 1..2021: note = mRNA product Design g-2 comprising derived and/or modified sequence from HRSV(A2)__F-del (artificial)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 782 - RNA, 2021 nt, synthetic construct
  misc_feature 1..2021: note = mRNA product Design g-2 comprising derived and/or modified sequence from HRSV(A2)__F-del (opt1)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 783 - RNA, 2021 nt, synthetic construct
  misc_feature 1..2021: note = mRNA product Design g-2 comprising derived and/or modified sequence from HRSV(A2)__F-del (opt1)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 784 - RNA, 2021 nt, synthetic construct
  misc_feature 1..2021: note = mRNA product Design g-2 comprising derived and/or modified sequence from HRSV(A2)__F-del (opt2)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 785 - RNA, 2021 nt, synthetic construct
  misc_feature 1..2021: note = mRNA product Design g-2 comprising derived and/or modified sequence from HRSV(A2)__F-del (opt3)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 786 - RNA, 2021 nt, synthetic construct
  misc_feature 1..2021: note = mRNA product Design g-2 comprising derived and/or modified sequence from HRSV(A2)__F-del (opt4)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 787 - RNA, 2021 nt, synthetic construct
  misc_feature 1..2021: note = mRNA product Design g-2 comprising derived and/or modified sequence from HRSV(A2)__F-del (opt5)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 788 - RNA, 2021 nt, synthetic construct
  misc_feature 1..2021: note = mRNA product Design g-2 comprising derived and/or modified sequence from HRSV(A2)__F-del (opt6)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 789 - RNA, 2021 nt, synthetic construct
  misc_feature 1..2021: note = mRNA product Design g-2 comprising derived and/or modified sequence from HRSV(A2)__F-del (opt11)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 790 - RNA, 2253 nt, synthetic construct
  misc_feature 1..2253: note = mRNA product Design g-3 comprising derived and/or modified sequence from HRSV(A2)__F-del (artificial)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 791 - RNA, 2253 nt, synthetic construct
  misc_feature 1..2253: note = mRNA product Design g-3 comprising derived and/or modified sequence from HRSV(A2)__F-del (opt1)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 792 - RNA, 2253 nt, synthetic construct
  misc_feature 1..2253: note = mRNA product Design g-3 comprising derived and/or modified sequence from HRSV(A2)__F-del (opt1)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 793 - RNA, 2253 nt, synthetic construct
  misc_feature 1..2253: note = mRNA product Design g-3 comprising derived and/or modified sequence from HRSV(A2)__F-del (opt2)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 794 - RNA, 2253 nt, synthetic construct
  misc_feature 1..2253: note = mRNA product Design g-3 comprising derived and/or modified sequence from HRSV(A2)__F-del (opt3)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 795 - RNA, 2253 nt, synthetic construct
  misc_feature 1..2253: note = mRNA product Design g-3 comprising derived and/or modified sequence from HRSV(A2)__F-del (opt4)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 796 - RNA, 2253 nt, synthetic construct
  misc_feature 1..2253: note = mRNA product Design g-3 comprising derived and/or modified sequence from HRSV(A2)__F-del (opt5)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 797 - RNA, 2253 nt, synthetic construct
  misc_feature 1..2253: note = mRNA product Design g-3 comprising derived and/or modified sequence from HRSV(A2)__F-del (opt6)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 798 - RNA, 2253 nt, synthetic construct
  misc_feature 1..2253: note = mRNA product Design g-3 comprising derived and/or modified sequence from HRSV(A2)__F-del (opt11)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 799 - RNA, 2048 nt, synthetic construct
  misc_feature 1..2048: note = mRNA product Design g-4 comprising derived and/or modified sequence from HRSV(A2)__F-del (artificial)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 800 - RNA, 2048 nt, synthetic construct
  misc_feature 1..2048: note = mRNA product Design g-4 comprising derived and/or modified sequence from HRSV(A2)__F-del (opt1)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 801 - RNA, 2048 nt, synthetic construct
  misc_feature 1..2048: note = mRNA product Design g-4 comprising derived and/or modified sequence from HRSV(A2)__F-del (opt1)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 802 - RNA, 2048 nt, synthetic construct
  misc_feature 1..2048: note = mRNA product Design g-4 comprising derived and/or modified sequence from HRSV(A2)__F-del (opt2)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 803 - RNA, 2048 nt, synthetic construct
  misc_feature 1..2048: note = mRNA product Design g-4 comprising derived and/or modified sequence from HRSV(A2)__F-del (opt3)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 804 - RNA, 2048 nt, synthetic construct
  misc_feature 1..2048: note = mRNA product Design g-4 comprising derived and/or modified sequence from HRSV(A2)__F-del (opt4)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 805 - RNA, 2048 nt, synthetic construct
  misc_feature 1..2048: note = mRNA product Design g-4 comprising derived and/or modified sequence from HRSV(A2)__F-del (opt5)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 806 - RNA, 2048 nt, synthetic construct
  misc_feature 1..2048: note = mRNA product Design g-4 comprising derived and/or modified sequence from HRSV(A2)__F-del (opt6)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 807 - RNA, 2048 nt, synthetic construct
  misc_feature 1..2048: note = mRNA product Design g-4 comprising derived and/or modified sequence from HRSV(A2)__F-del (opt11)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 808 - RNA, 2024 nt, synthetic construct
  misc_feature 1..2024: note = mRNA product Design g-5 comprising derived and/or modified sequence from HRSV(A2)__F-del (artificial)
  source 1..2024: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 809 - RNA, 2024 nt, synthetic construct
  misc_feature 1..2024: note = mRNA product Design g-5 comprising derived and/or modified sequence from HRSV(A2)__F-del (opt1)
  source 1..2024: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 810 - RNA, 2024 nt, synthetic construct
  misc_feature 1..2024: note = mRNA product Design g-5 comprising derived and/or modified sequence from HRSV(A2)__F-del (opt1)
  source 1..2024: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 811 - RNA, 2024 nt, synthetic construct
  misc_feature 1..2024: note = mRNA product Design g-5 comprising derived and/or modified sequence from HRSV(A2)__F-del (opt2)
  source 1..2024: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 812 - RNA, 2024 nt, synthetic construct
  misc_feature 1..2024: note = mRNA product Design g-5 comprising derived and/or modified sequence from HRSV(A2)__F-del (opt3)
  source 1..2024: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 813 - RNA, 2024 nt, synthetic construct
  misc_feature 1..2024: note = mRNA product Design g-5 comprising derived and/or modified sequence from HRSV(A2)__F-del (opt4)
  source 1..2024: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 814 - RNA, 2024 nt, synthetic construct
  misc_feature 1..2024: note = mRNA product Design g-5 comprising derived and/or modified sequence from HRSV(A2)__F-del (opt5)
  source 1..2024: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 815 - RNA, 2024 nt, synthetic construct
  misc_feature 1..2024: note = mRNA product Design g-5 comprising derived and/or modified sequence from HRSV(A2)__F-del (opt6)
  source 1..2024: mol_type = other RNA
gggagacccgtgacccggaagttgtacggctacgcgactttccctcccacaaaccctcgcgcccttcctttcctacttgggcccggcagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 816 - RNA, 2024 nt, synthetic construct
  misc_feature 1..2024: note = mRNA product Design g-5 comprising derived and/or modified sequence from HRSV(A2)__F-del (opt11)
  source 1..2024: mol_type = other RNA
gggagacccgtgacccggaagttgtacggctacgcgactttccctcccacaaaccctcgcgcccttcctttcctacttgggcccggcagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 817 - RNA, 2040 nt, synthetic construct
  misc_feature 1..2040: note = mRNA product Design h-1 comprising derived and/or modified sequence from HRSV(A2)__F-del (artificial)
  source 1..2040: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 818 - RNA, 2040 nt, synthetic construct
  misc_feature 1..2040: note = mRNA product Design h-1 comprising derived and/or modified sequence from HRSV(A2)__F-del (opt1)
  source 1..2040: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 819 - RNA, 2040 nt, synthetic construct
  misc_feature 1..2040: note = mRNA product Design h-1 comprising derived and/or modified sequence from HRSV(A2)__F-del (opt1)
  source 1..2040: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 820 - RNA, 2040 nt, synthetic construct
  misc_feature 1..2040: note = mRNA product Design h-1 comprising derived and/or modified sequence from HRSV(A2)__F-del (opt2)
  source 1..2040: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 821 - RNA, 2040 nt, synthetic construct
  misc_feature 1..2040: note = mRNA product Design h-1 comprising derived and/or modified sequence from HRSV(A2)__F-del (opt3)
  source 1..2040: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 822 - RNA, 2040 nt, synthetic construct
  misc_feature 1..2040: note = mRNA product Design h-1 comprising derived and/or modified sequence from HRSV(A2)__F-del (opt4)
  source 1..2040: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 823 - RNA, 2040 nt, synthetic construct
  misc_feature 1..2040: note = mRNA product Design h-1 comprising derived and/or modified sequence from HRSV(A2)__F-del (opt5)
  source 1..2040: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 824 - RNA, 2040 nt, synthetic construct
  misc_feature 1..2040: note = mRNA product Design h-1 comprising derived and/or modified sequence from HRSV(A2)__F-del (opt6)
  source 1..2040: mol_type = other RNA
gggagacccgtgacccggaagttgtacggctacgcgactttccctcccacaaaccctcgcgcccttcctttcctacttgggcccggcagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 825 - RNA, 2040 nt, synthetic construct
  misc_feature 1..2040: note = mRNA product Design h-1 comprising derived and/or modified sequence from HRSV(A2)__F-del (opt11)
  source 1..2040: mol_type = other RNA
gggagacccgtgacccggaagttgtacggctacgcgactttccctcccacaaaccctcgcgcccttcctttcctacttgggcccggcagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 826 - RNA, 2256 nt, synthetic construct
  misc_feature 1..2256: note = mRNA product Design h-2 comprising derived and/or modified sequence from HRSV(A2)__F-del (artificial)
  source 1..2256: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 827 - RNA, 2256 nt, synthetic construct
  misc_feature 1..2256: note = mRNA product Design h-2 comprising derived and/or modified sequence from HRSV(A2)__F-del (opt1)
  source 1..2256: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 828 - RNA, 2256 nt, synthetic construct
  misc_feature 1..2256: note = mRNA product Design h-2 comprising derived and/or modified sequence from HRSV(A2)__F-del (opt1)
  source 1..2256: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 829 - RNA, 2256 nt, synthetic construct
  misc_feature 1..2256: note = mRNA product Design h-2 comprising derived and/or modified sequence from HRSV(A2)__F-del (opt2)
  source 1..2256: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 830 - RNA, 2256 nt, synthetic construct
  misc_feature 1..2256: note = mRNA product Design h-2 comprising derived and/or modified sequence from HRSV(A2)__F-del (opt3)
  source 1..2256: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 831 - RNA, 2256 nt, synthetic construct
  misc_feature 1..2256: note = mRNA product Design h-2 comprising derived and/or modified sequence from HRSV(A2)__F-del (opt4)
  source 1..2256: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 832 - RNA, 2256 nt, synthetic construct
  misc_feature 1..2256: note = mRNA product Design h-2 comprising derived and/or modified sequence from HRSV(A2)__F-del (opt5)
  source 1..2256: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 833 - RNA, 2256 nt, synthetic construct
  misc_feature 1..2256: note = mRNA product Design h-2 comprising derived and/or modified sequence from HRSV(A2)__F-del (opt6)
  source 1..2256: mol_type = other RNA
gggagacccgtgacccggaagttgtacggctacgcgactttccctcccacaaaccctcgcgcccttcctttcctacttgggcccggcagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 834 - RNA, 2256 nt, synthetic construct
  misc_feature 1..2256: note = mRNA product Design h-2 comprising derived and/or modified sequence from HRSV(A2)__F-del (opt11)
  source 1..2256: mol_type = other RNA
gggagacccgtgacccggaagttgtacggctacgcgactttccctcccacaaaccctcgcgcccttcctttcctacttgggcccggcagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 835 - RNA, 2036 nt, synthetic construct
  misc_feature 1..2036: note = mRNA product Design h-3 comprising derived and/or modified sequence from HRSV(A2)__F-del (artificial)
  source 1..2036: mol_type = other RNA
gggagacccgtgacccggaagttgtacggctacgcgactttccctcccacaaaccctcgcgcccttcctttcctacttgggcccggcagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 836 - RNA, 2036 nt, synthetic construct
  misc_feature 1..2036: note = mRNA product Design h-3 comprising derived and/or modified sequence from HRSV(A2)__F-del (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 837 - RNA, 2036 nt, synthetic construct
  misc_feature 1..2036: note = mRNA product Design h-3 comprising derived and/or modified sequence from HRSV(A2)__F-del (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 838 - RNA, 2036 nt, synthetic construct
  misc_feature 1..2036: note = mRNA product Design h-3 comprising derived and/or modified sequence from HRSV(A2)__F-del (opt2)
  source 1..2036: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 839 - RNA, 2036 nt, synthetic construct
  misc_feature 1..2036: note = mRNA product Design h-3 comprising derived and/or modified sequence from HRSV(A2)__F-del (opt3)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 840 - RNA, 2036 nt, synthetic construct
  misc_feature 1..2036: note = mRNA product Design h-3 comprising derived and/or modified sequence from HRSV(A2)__F-del (opt4)
  source 1..2036: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 841 - RNA, 2036 nt, synthetic construct
  misc_feature 1..2036: note = mRNA product Design h-3 comprising derived and/or modified sequence from HRSV(A2)__F-del (opt5)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 842 - RNA, 2036 nt, synthetic construct
  misc_feature 1..2036: note = mRNA product Design h-3 comprising derived and/or modified sequence from HRSV(A2)__F-del (opt6)
  source 1..2036: mol_type = other RNA
gggagacccgtgacccggaagttgtacggctacgcgactttccctcccacaaaccctcgcgcccttcctttcctacttgggcccggcagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 843 - RNA, 2036 nt, synthetic construct
  misc_feature 1..2036: note = mRNA product Design h-3 comprising derived and/or modified sequence from HRSV(A2)__F-del (opt11)
  source 1..2036: mol_type = other RNA
gggagacccgtgacccggaagttgtacggctacgcgactttccctcccacaaaccctcgcgcccttcctttcctacttgggcccggcagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 844 - RNA, 2099 nt, synthetic construct
  misc_feature 1..2099: note = mRNA product Design h-4 comprising derived and/or modified sequence from HRSV(A2)__F-del (artificial)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 845 - RNA, 2099 nt, synthetic construct
  misc_feature 1..2099: note = mRNA product Design h-4 comprising derived and/or modified sequence from HRSV(A2)__F-del (opt1)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 846 - RNA, 2099 nt, synthetic construct
  misc_feature 1..2099: note = mRNA product Design h-4 comprising derived and/or modified sequence from HRSV(A2)__F-del (opt1)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 847 - RNA, 2099 nt, synthetic construct
  misc_feature 1..2099: note = mRNA product Design h-4 comprising derived and/or modified sequence from HRSV(A2)__F-del (opt2)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 848 - RNA, 2099 nt, synthetic construct
  misc_feature 1..2099: note = mRNA product Design h-4 comprising derived and/or modified sequence from HRSV(A2)__F-del (opt3)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 849 - RNA, 2099 nt, synthetic construct
  misc_feature 1..2099: note = mRNA product Design h-4 comprising derived and/or modified sequence from HRSV(A2)__F-del (opt4)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 850 - RNA, 2099 nt, synthetic construct
  misc_feature 1..2099: note = mRNA product Design h-4 comprising derived and/or modified sequence from HRSV(A2)__F-del (opt5)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 851 - RNA, 2099 nt, synthetic construct
  misc_feature 1..2099: note = mRNA product Design h-4 comprising derived and/or modified sequence from HRSV(A2)__F-del (opt6)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 852 - RNA, 2099 nt, synthetic construct
  misc_feature 1..2099: note = mRNA product Design h-4 comprising derived and/or modified sequence from HRSV(A2)__F-del (opt11)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 853 - RNA, 2115 nt, synthetic construct
  misc_feature 1..2115: note = mRNA product Design h-5 comprising derived and/or modified sequence from HRSV(A2)__F-del (artificial)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 854 - RNA, 2115 nt, synthetic construct
  misc_feature 1..2115: note = mRNA product Design h-5 comprising derived and/or modified sequence from HRSV(A2)__F-del (opt1)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 855 - RNA, 2115 nt, synthetic construct
  misc_feature 1..2115: note = mRNA product Design h-5 comprising derived and/or modified sequence from HRSV(A2)__F-del (opt1)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 856 - RNA, 2115 nt, synthetic construct
  misc_feature 1..2115: note = mRNA product Design h-5 comprising derived and/or modified sequence from HRSV(A2)__F-del (opt2)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 857 - RNA, 2115 nt, synthetic construct
  misc_feature 1..2115: note = mRNA product Design h-5 comprising derived and/or modified sequence from HRSV(A2)__F-del (opt3)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 858 - RNA, 2115 nt, synthetic construct
  misc_feature 1..2115: note = mRNA product Design h-5 comprising derived and/or modified sequence from HRSV(A2)__F-del (opt4)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 859 - RNA, 2115 nt, synthetic construct
  misc_feature 1..2115: note = mRNA product Design h-5 comprising derived and/or modified sequence from HRSV(A2)__F-del (opt5)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 860 - RNA, 2115 nt, synthetic construct
  misc_feature 1..2115: note = mRNA product Design h-5 comprising derived and/or modified sequence from HRSV(A2)__F-del (opt6)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 861 - RNA, 2115 nt, synthetic construct
  misc_feature 1..2115: note = mRNA product Design h-5 comprising derived and/or modified sequence from HRSV(A2)__F-del (opt11)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 862 - RNA, 2048 nt, synthetic construct
  misc_feature 1..2048: note = mRNA product Design i-1 comprising derived and/or modified sequence from HRSV(A2)__F-del (artificial)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 863 - RNA, 2048 nt, synthetic construct
  misc_feature 1..2048: note = mRNA product Design i-1 comprising derived and/or modified sequence from HRSV(A2)__F-del (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 864 - RNA, 2048 nt, synthetic construct
  misc_feature 1..2048: note = mRNA product Design i-1 comprising derived and/or modified sequence from HRSV(A2)__F-del (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 865 - RNA, 2048 nt, synthetic construct
  misc_feature 1..2048: note = mRNA product Design i-1 comprising derived and/or modified sequence from HRSV(A2)__F-del (opt2)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 866 - RNA, 2048 nt, synthetic construct
  misc_feature 1..2048: note = mRNA product Design i-1 comprising derived and/or modified sequence from HRSV(A2)__F-del (opt3)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 867 - RNA, 2048 nt, synthetic construct
  misc_feature 1..2048: note = mRNA product Design i-1 comprising derived and/or modified sequence from HRSV(A2)__F-del (opt4)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 868 - RNA, 2048 nt, synthetic construct
  misc_feature 1..2048: note = mRNA product Design i-1 comprising derived and/or modified sequence from HRSV(A2)__F-del (opt5)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 869 - RNA, 2048 nt, synthetic construct
  misc_feature 1..2048: note = mRNA product Design i-1 comprising derived and/or modified sequence from HRSV(A2)__F-del (opt6)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 870 - RNA, 2048 nt, synthetic construct
  misc_feature 1..2048: note = mRNA product Design i-1 comprising derived and/or modified sequence from HRSV(A2)__F-del (opt11)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 871 - RNA, 2048 nt, synthetic construct
  misc_feature 1..2048: note = mRNA product Design i-2 comprising derived and/or modified sequence from HRSV(A2)__F-del (artificial)
  source 1..2048: mol_type = other RNA
gggagaggcgctgcctacggaggtggcagccatctccttctcggcatcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 872 - RNA, 2048 nt, synthetic construct
  misc_feature 1..2048: note = mRNA product Design i-2 comprising derived and/or modified sequence from HRSV(A2)__F-del (opt1)
  source 1..2048: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 873 - RNA, 2048 nt, synthetic construct
  misc_feature 1..2048: note = mRNA product Design i-2 comprising derived and/or modified sequence from HRSV(A2)__F-del (opt1)
  source 1..2048: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 874 - RNA, 2048 nt, synthetic construct
  misc_feature 1..2048: note = mRNA product Design i-2 comprising derived and/or modified sequence from HRSV(A2)__F-del (opt2)
  source 1..2048: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 875 - RNA, 2048 nt, synthetic construct
  misc_feature 1..2048: note = mRNA product Design i-2 comprising derived and/or modified sequence from HRSV(A2)__F-del (opt3)
  source 1..2048: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 876 - RNA, 2048 nt, synthetic construct
  misc_feature 1..2048: note = mRNA product Design i-2 comprising derived and/or modified sequence from HRSV(A2)__F-del (opt4)
  source 1..2048: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 877 - RNA, 2048 nt, synthetic construct
  misc_feature 1..2048: note = mRNA product Design i-2 comprising derived and/or modified sequence from HRSV(A2)__F-del (opt5)
  source 1..2048: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 878 - RNA, 2048 nt, synthetic construct
  misc_feature 1..2048: note = mRNA product Design i-2 comprising derived and/or modified sequence from HRSV(A2)__F-del (opt6)
  source 1..2048: mol_type = other RNA
gggagaggcgctgcctacggaggtggcagccatctccttctcggcatcaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 879 - RNA, 2048 nt, synthetic construct
  misc_feature 1..2048: note = mRNA product Design i-2 comprising derived and/or modified sequence from HRSV(A2)__F-del (opt11)
  source 1..2048: mol_type = other RNA
gggagaggcgctgcctacggaggtggcagccatctccttctcggcatcaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 880 - RNA, 2044 nt, synthetic construct
  misc_feature 1..2044: note = mRNA product Design i-2 comprising derived and/or modified sequence from HRSV(A2)__F-del (artificial)
  source 1..2044: mol_type = other RNA
ggggcgctgcctacggaggtggcagccatctccttctcggcatcaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 881 - RNA, 2044 nt, synthetic construct
  misc_feature 1..2044: note = mRNA product Design i-2 comprising derived and/or modified sequence from HRSV(A2)__F-del (opt1) R3738/R3939
  source 1..2044: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 882 - RNA, 2044 nt, synthetic construct
  misc_feature 1..2044: note = mRNA product Design i-2 comprising derived and/or modified sequence from HRSV(A2)__F-del (opt1)
  source 1..2044: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 883 - RNA, 2044 nt, synthetic construct
  misc_feature 1..2044: note = mRNA product Design i-2 comprising derived and/or modified sequence from HRSV(A2)__F-del (opt2)
  source 1..2044: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 884 - RNA, 2044 nt, synthetic construct
  misc_feature 1..2044: note = mRNA product Design i-2 comprising derived and/or modified sequence from HRSV(A2)__F-del (opt3)
  source 1..2044: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 885 - RNA, 2044 nt, synthetic construct
  misc_feature 1..2044: note = mRNA product Design i-2 comprising derived and/or modified sequence from HRSV(A2)__F-del (opt4)
  source 1..2044: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 886 - RNA, 2044 nt, synthetic construct
  misc_feature 1..2044: note = mRNA product Design i-2 comprising derived and/or modified sequence from HRSV(A2)__F-del (opt5)
  source 1..2044: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 887 - RNA, 2044 nt, synthetic construct
  misc_feature 1..2044: note = mRNA product Design i-2 comprising derived and/or modified sequence from HRSV(A2)__F-del (opt6)
  source 1..2044: mol_type = other RNA
ggggcgctgcctacggaggtggcagccatctccttctcggcatcaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 888 - RNA, 2044 nt, synthetic construct
  misc_feature 1..2044: note = mRNA product Design i-2 comprising derived and/or modified sequence from HRSV(A2)__F-del (opt11)
  source 1..2044: mol_type = other RNA
ggggcgctgcctacggaggtggcagccatctccttctcggcatcaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 889 - RNA, 1879 nt, synthetic construct
  misc_feature 1..1879: note = mRNA product Design i-3 comprising derived and/or modified sequence from HRSV(A2)__F-del (artificial)
  source 1..1879: mol_type = other RNA
gggagaaagcttaccatggagttgctaatcctcaaagcaaatgcaattaccacaatcctcactgcagtcacattttgttttgcttctggtcaaaacatcactgaagaattttatcaatcaacatgcagtgcagttagcaaaggctatcttagtgctctgagaactggttggtataccagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcaacaaacaatcgagccagaagagaactaccaaggtttatgaattatacactcaacaatgccaaaaaaaccaatgtaacattaagcaagaaaaggaaaagaagatttcttggttttttgttaggtgttggatctgcaatcgccagtggcgttgctgtatctaaggtcctgcacctagaaggggaagtgaacaagatcaaaagtgctctactatccacaaacaaggctgtagtcagcttatcaaatggagttagtgtcttaaccagcaaagtgttagacctcaaaaactatatagataaacaattgttacctattgtgaacaagcaaagctgcagcatatcaaatatagaaactgtgatagagttccaacaaaagaacaacagactactagagattaccagggaatttagtgttaatgcaggtgtaactacacctgtaagcacttacatgttaactaatagtgaattattgtcattaatcaatgatatgcctataacaaatgatcagaaaaagttaatgtccaacaatgttcaaatagttagacagcaaagttactctatcatgtccataataaaagaggaagtcttagcatatgtagtacaattaccactatatggtgttatagatacaccctgttggaaactacacacatcccctctatgtacaaccaacacaaaagaagggtccaacatctgtttaacaagaactgacagaggatggtactgtgacaatgcaggatcagtatctttcttcccacaagctgaaacatgtaaagttcaatcaaatcgagtattttgtgacacaatgaacagtttaacattaccaagtgaagtaaatctctgcaatgttgacatattcaaccccaaatatgattgtaaaattatgacttcaaaaacagatgtaagcagctccgttatcacatctctaggagccattgtgtcatgctatggcaaaactaaatgtacagcatccaataaaaatcgtggaatcataaagacattttctaacgggtgcgattatgtatcaaataaaggggtggacactgtgtctgtaggtaacacattatattatgtaaataagcaagaaggtaaaagtctctatgtaaaaggtgaaccaataataaatttctatgacccattagtattcccctctgatgaatttgatgcatcaatatctcaagtcaacgagaagattaaccagagcctagcatttattcgtaaatccgatgaattattacataatgtaaatgctggtaaatccaccacaaatatcatgataactactataattatagtgattatagtaatattgttatcattaattgctgttggactgctcttatactgtaaggccagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 890 - RNA, 1879 nt, synthetic construct
  misc_feature 1..1879: note = mRNA product Design i-3 comprising derived and/or modified sequence from HRSV(A2)__F-del (opt1) R6940
  source 1..1879: mol_type = other RNA
gggagaaagcttaccatggagctgctcatcctgaaggccaacgccatcaccaccatcctgacggcggtgaccttctgcttcgccagcggccagaacatcaccgaggagttctaccagtccacctgcagcgccgtctccaaggggtacctcagcgccctgcggacgggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtccatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 891 - RNA, 1879 nt, synthetic construct
  misc_feature 1..1879: note = mRNA product Design i-3 comprising derived and/or modified sequence from HRSV(A2)__F-del (opt1)
  source 1..1879: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtccaaggtgctgcacctcgagggggaggtcaacaagatcaagagcgccctgctgtccaccaacaaggccgtggtgagcctctccaacggcgtcagcgtgctgacctccaaggtgctggacctcaagaactacatcgacaagcagctgctgcccatcgtcaacaagcagagctgctccatcagcaacatcgagacggtgatcgagttccagcagaagaacaaccgcctcctggagatcacccgggagttcagcgtgaacgcgggggtcaccacccccgtgtccacgtacatgctgaccaacagcgagctcctgtccctgatcaacgacatgcccatcaccaacgaccagaagaagctcatgagcaacaacgtgcagatcgtccgccagcagtcctacagcatcatgtccatcatcaaggaggaggtgctggcctacgtggtccagctgccgctctacggcgtgatcgacaccccctgctggaagctgcacacgagccccctgtgcaccaccaacaccaaggaggggtccaacatctgcctcacgcggaccgaccgcggctggtactgcgacaacgccggcagcgtctccttcttcccccaggccgagacctgcaaggtgcagagcaaccgggtgttctgcgacaccatgaactccctgacgctgccgagcgaggtcaacctctgcaacgtggacatcttcaaccccaagtacgactgcaagatcatgacctccaagaccgacgtgagctccagcgtcatcacctccctgggggccatcgtgagctgctacggcaagacgaagtgcaccgcgagcaacaagaaccgcgggatcatcaagaccttctccaacggctgcgactacgtgagcaacaagggcgtcgacaccgtgtccgtggggaacaccctgtactacgtcaacaagcaggagggcaagagcctctacgtgaagggggagcccatcatcaacttctacgaccccctggtgttcccgtccgacgagttcgacgccagcatctcccaggtcaacgagaagatcaaccagagcctggccttcatccggaagtccgacgagctcctgcacaacgtgaacgccggcaagagcacgaccaacatcatgatcaccaccatcatcatcgtgatcatcgtcatcctgctgtccctcatcgccgtggggctgctgctctactgcaaggcgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 892 - RNA, 1879 nt, synthetic construct
  misc_feature 1..1879: note = mRNA product Design i-3 comprising derived and/or modified sequence from HRSV(A2)__F-del (opt2)
  source 1..1879: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctccaaggtcctccacctcgagggcgaggtcaacaagatcaagtccgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 893 - RNA, 1879 nt, synthetic construct
  misc_feature 1..1879: note = mRNA product Design i-3 comprising derived and/or modified sequence from HRSV(A2)__F-del (opt3)
  source 1..1879: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgttagtaaggtgctgcaccttgaaggtgaggtcaacaaaatcaagtccgcgttgctgtctacaaataaagcagtggtaagcctatccaacggggtttcagtgctcacttctaaggtcctggaccttaaaaattatattgataagcaactgttgccaatcgtgaacaaacagagctgttctatttccaacatcgaaaccgtgatagagttccagcagaagaataaccggctcctggagattacacgcgaattttcagtcaatgccggagttaccacgccggtgagcacttacatgttaacaaacagtgagctgctctctcttatcaatgacatgcccattaccaacgatcaaaagaaactgatgtccaataacgtacagatcgtgagacagcagagctattcgatcatgtctattataaaggaagaggtcttggcttacgtggttcaactacctctgtacggcgtgatcgacactccatgctggaaactccatacatccccactgtgtaccacgaataccaaggaaggctcaaacatttgccttacaaggactgatcgggggtggtattgtgacaatgccggaagtgtcagcttctttcctcaggcagagacctgcaaagtgcagtccaaccgcgtattctgtgatacaatgaatagtctgactttgccaagcgaggttaacctctgcaatgtggacatctttaaccccaagtacgattgtaagataatgacctcaaaaacagacgtcagttccagcgtgattacctctctgggtgctatcgtctcatgctatggcaagactaaatgcacggccagtaacaagaatcgagggatcattaaaacattcagcaacggatgtgattacgtgtccaataagggcgttgacaccgtgtctgtaggtaacactttatattacgtcaataagcaagaagggaaatcgctgtatgtgaagggagagcctatcattaacttttacgaccccctagttttcccgagcgatgaatttgacgcgtccatatcacaggtgaatgagaaaatcaaccagagtctcgccttcattagaaagtctgatgaactgcttcacaatgtcaacgcaggcaaaagcaccacaaatatcatgatcaccactattataatcgtgattatcgtaattttgctgtccctcatcgctgtgggcctgcttctgtactgcaaggccaggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 894 - RNA, 1879 nt, synthetic construct
  misc_feature 1..1879: note = mRNA product Design i-3 comprising derived and/or modified sequence from HRSV(A2)__F-del (opt4)
  source 1..1879: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgagcaaggtgctgcacctggagggcgaggtgaacaagatcaagagcgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 895 - RNA, 1879 nt, synthetic construct
  misc_feature 1..1879: note = mRNA product Design i-3 comprising derived and/or modified sequence from HRSV(A2)__F-del (opt5)
  source 1..1879: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgagcaaggtccttcacctggaaggagaggtgaacaaaatcaagtctgccctcctgtccacgaataaagctgttgtgagcctgtctaacggcgtctccgtgctcacaagcaaggtgctggaccttaaaaattatattgataagcaactgctcccgatcgtcaacaaacagtcttgttccattagcaacatcgaaaccgttattgagttccagcagaagaataaccgcctgcttgagatcacaagagaattttccgtgaatgccggcgtgaccacccccgtctctacatacatgctgacgaacagcgagctcctgtccctgatcaatgacatgcctattaccaacgatcaaaagaaactcatgagcaataacgtgcagatcgttcggcagcagtcttattccattatgagcatcattaaggaagaggtgctggcgtacgtcgtgcaacttcccctgtacggggttatcgacacaccttgctggaaactccatacctctcccctgtgtacaaccaatacgaaggaaggaagcaacatctgccttacacgcaccgatagaggctggtattgtgacaatgccgggtccgtgtctttctttcctcaggctgagacctgcaaagtccagagcaaccgggtgttctgtgatacaatgaactccctgaccctcccgagcgaggtcaatctgtgcaatgtggacatttttaaccccaagtacgattgtaagatcatgacatctaaaacggacgtttccagctctgtgattacctccctgggagccatcgtcagctgctatggcaagacaaaatgcaccgcttccaacaagaatcgcgggattatcaaaacattctctaacggatgtgattacgtgagcaataagggcgttgacaccgtgtccgtcggcaacacgctctattacgtgaataagcaagaagggaaatctctgtatgtgaagggagagcctatcattaacttttacgacccccttgttttccctagcgatgaatttgacgcctccatcagccaggtcaatgagaaaattaaccagtctctggccttcatcagaaagtccgatgaactcctgcacaatgtgaacgctggcaaaagcaccacaaatattatgatcaccacaattatcatcgtgattatcgtcattctgctttctctcatcgcggtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 896 - RNA, 1879 nt, synthetic construct
  misc_feature 1..1879: note = mRNA product Design i-3 comprising derived and/or modified sequence from HRSV(A2)__F-del (opt6)
  source 1..1879: mol_type = other RNA
gggagaaagcttaccatggaattactaatactcaaagccaacgcaataacaacaatactaacagcagtaacattctgcttcgcatcaggacaaaacatcacagaagaattttaccaaagtacatgcagtgcagtctctaaaggatacctcagtgccttacgcacaggatggtacacatcagtaataacaatcgaactttcaaacataaaagaaaacaaatgcaatggaaccgacgccaaagtaaaactaatcaaacaagaactagacaaatataaaaatgcagtaacagaattacaactcctaatgcaatccacaccagcaacaaataacagagcaagacgagaactccctcgattcatgaattacacattaaacaacgcaaaaaaaactaacgtaactttatcaaaaaaaagaaaacgtagatttctaggattcctactaggcgtagggtccgccattgcatcaggagtagcagttagcaaagtattacatttagaaggagaagtaaataaaatcaaaagcgcactactctcaaccaacaaagcagtagtatcactctcaaacggagtatcagtactaacatccaaagtactcgacctcaaaaactacatagacaaacaattactacccatagtaaacaaacaatcatgctctatatcaaatatcgaaacagtaatcgaatttcaacaaaaaaacaatcgactacttgaaataacaagagagttctccgtcaatgccggagtcaccacaccagtctcaacatacatgctaaccaactctgaactcctatcactaataaatgacatgccaataacaaacgaccaaaaaaaactaatgtcaaataacgtacaaatagtacgacaacaaagttattccataatgagtataatcaaagaagaagtgttagcatacgtagtccaactaccattatatggagtaatagacacaccatgttggaaattacacacctcaccactctgcactaccaatacaaaagaaggctcaaatatatgcctaactcgcacagacagaggctggtactgcgataacgcaggatccgtatctttctttccccaagcagaaacttgcaaagtacaatcaaacagagtcttctgcgacaccatgaatagtctcacattaccatctgaagtaaacctatgtaacgtagatatattcaatccaaaatacgactgcaaaataatgacatcaaaaaccgacgtctctagcagtgtaatcacatcactaggagcaatagtaagctgctatggaaaaacaaaatgtacagcatcaaacaaaaacaggggaataataaaaaccttctcaaacggatgtgactacgtatcaaataaaggcgtagacacagtaagcgtaggaaacaccctatactacgttaacaaacaagaagggaaatcattatacgtaaaaggagaaccaataataaacttctacgatccactcgtattcccatccgacgaatttgacgccagcatatcccaagttaacgaaaaaataaaccaatcacttgcatttatacgaaaatctgatgaacttctccacaacgtaaatgcaggaaaatccaccaccaatataatgatcacaactatcatcatagtaataatcgtcattttactatcattaatagcagttggcctacttctatactgcaaagcaagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 897 - RNA, 1879 nt, synthetic construct
  misc_feature 1..1879: note = mRNA product Design i-3 comprising derived and/or modified sequence from HRSV(A2)__F-del (opt11)
  source 1..1879: mol_type = other RNA
gggagaaagcttaccatggaactactaatcctaaaagccaacgcgatcaccaccatcctaacggcagtcaccttctgcttcgcatcaggccaaaacatcacagaagagttctaccaaagcacatgctccgccgtatccaaaggctacctcagcgccctacgcacaggctggtacacatctgtcatcaccatagaactctccaacatcaaagaaaacaaatgcaacggcactgacgccaaagtaaagctgatcaaacaagaactcgacaaatacaaaaacgcagtcaccgaactccaactactcatgcaatccacccctgcaaccaacaacagggcccgccgcgaactcccccgcttcatgaactacactttaaacaacgccaaaaagaccaacgtcacactcagcaagaaacggaaacgacgattcctagggtttctcctaggcgtcggctcggcaatcgcctccggcgtcgccgtaagcaaagtactacacctagaaggcgaagtgaacaaaatcaaaagtgcccttctctccaccaacaaggccgtagtctctctatccaacggagtctcagtcctcacctcaaaggtcctcgacctcaaaaactacatcgacaaacaactactccccattgtcaacaagcagtcatgctccatatcaaacatcgaaaccgtcatcgagttccaacagaaaaacaaccgactcctcgaaataaccagagagttctcggtcaacgccggcgtcaccaccccagtcagcacctacatgctcactaactccgaactcctatccctcatcaacgacatgccaattaccaacgaccaaaagaaactaatgtcgaacaacgttcaaatcgtccgacaacaaagttactccatcatgagcataatcaaagaagaagttctagcgtacgtcgtccaactcccactatacggcgtcatcgacactccgtgctggaaactccacacatcacccctatgtacaaccaacacaaaagaaggcagcaacatctgcctcacccgcaccgaccgagggtggtattgcgataacgctggcagcgtctccttcttcccccaagccgaaacctgcaaagtccaatcaaacagagtattctgcgacaccatgaactcccttactctccctagcgaagtcaacctctgcaacgttgacatattcaaccccaaatacgactgcaaaatcatgacctccaagaccgacgtctcctcctccgtcatcacatctctaggtgccattgtctcctgctacggaaaaaccaaatgcacagcctccaacaaaaaccgcggcatcataaaaaccttctccaacggctgcgactacgtcagtaataaaggcgtcgacacggtatccgttgggaatacgctttactacgtaaataaacaagaaggcaaatccctctacgtcaaaggtgaacccatcataaacttctacgacccgcttgtgttcccatccgacgagttcgacgccagcatcagccaggtcaacgaaaagatcaaccaatccctagccttcatccgcaaaagcgacgaactactacacaacgtcaacgccggaaaatccacaaccaacatcatgatcaccaccatcatcatcgtcatcatcgtaatcctactctctctcatcgccgtcggcctcctactgtactgtaaagcccgatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 898 - protein, 574 aa, synthetic construct
  REGION 1..574: note = derived and/or modified protein sequence (artificial) from HRSV(A2)__F0_DSCav1
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 899 - RNA, 1725 nt, synthetic construct
  misc_feature 1..1725: note = derived and/or modified CDS sequence (opt1) from HRSV(A2)__F0_DSCav1
  source 1..1725: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 900 - RNA, 1725 nt, synthetic construct
  misc_feature 1..1725: note = derived and/or modified CDS sequence (opt1) from HRSV(A2)__F0_DSCav1
  source 1..1725: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactga

SEQ ID NO: 901 - RNA, 1725 nt, synthetic construct
  misc_feature 1..1725: note = derived and/or modified CDS sequence (opt2) from HRSV(A2)__F0_DSCav1
  source 1..1725: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 902 - RNA, 1725 nt, synthetic construct
  misc_feature 1..1725: note = derived and/or modified CDS sequence (opt3) from HRSV(A2)__F0_DSCav1
  source 1..1725: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactga

SEQ ID NO: 903 - RNA, 1725 nt, synthetic construct
  misc_feature 1..1725: note = derived and/or modified CDS sequence (opt4) from HRSV(A2)__F0_DSCav1
  source 1..1725: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 904 - RNA, 1725 nt, synthetic construct
  misc_feature 1..1725: note = derived and/or modified CDS sequence (opt5) from HRSV(A2)__F0_DSCav1
  source 1..1725: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactga

SEQ ID NO: 905 - RNA, 1725 nt, synthetic construct
  misc_feature 1..1725: note = derived and/or modified CDS sequence (opt6) from HRSV(A2)__F0_DSCav1
  source 1..1725: mol_type = other RNA
atggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaa

SEQ ID NO: 906 - RNA, 1725 nt, synthetic construct
  misc_feature 1..1725: note = derived and/or modified CDS sequence (opt11) from HRSV(A2)__F0_DSCav1
  source 1..1725: mol_type = other RNA
atggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaa

SEQ ID NO: 907 - RNA, 2001 nt, synthetic construct
  misc_feature 1..2001: note = mRNA product Design a-1 comprising derived and/or modified sequence from HRSV(A2)__F0_DSCav1 (opt1)
  source 1..2001: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 908 - RNA, 2001 nt, synthetic construct
  misc_feature 1..2001: note = mRNA product Design a-1 comprising derived and/or modified sequence from HRSV(A2)__F0_DSCav1 (opt1)
  source 1..2001: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 909 - RNA, 2001 nt, synthetic construct
  misc_feature 1..2001: note = mRNA product Design a-1 comprising derived and/or modified sequence from HRSV(A2)__F0_DSCav1 (opt2)
  source 1..2001: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 910 - RNA, 2001 nt, synthetic construct
  misc_feature 1..2001: note = mRNA product Design a-1 comprising derived and/or modified sequence from HRSV(A2)__F0_DSCav1 (opt3)
  source 1..2001: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 911 - RNA, 2001 nt, synthetic construct
  misc_feature 1..2001: note = mRNA product Design a-1 comprising derived and/or modified sequence from HRSV(A2)__F0_DSCav1 (opt4)
  source 1..2001: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 912 - RNA, 2001 nt, synthetic construct
  misc_feature 1..2001: note = mRNA product Design a-1 comprising derived and/or modified sequence from HRSV(A2)__F0_DSCav1 (opt5)
  source 1..2001: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 913 - RNA, 2001 nt, synthetic construct
  misc_feature 1..2001: note = mRNA product Design a-1 comprising derived and/or modified sequence from HRSV(A2)__F0_DSCav1 (opt6)
  source 1..2001: mol_type = other RNA
gggagagtcccgcagtcggcgtccagcggctctgcttgttcgtgtgtgtgtcgttgcaggccttattcaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 914 - RNA, 2001 nt, synthetic construct
  misc_feature 1..2001: note = mRNA product Design a-1 comprising derived and/or modified sequence from HRSV(A2)__F0_DSCav1 (opt11)
  source 1..2001: mol_type = other RNA
gggagagtcccgcagtcggcgtccagcggctctgcttgttcgtgtgtgtgtcgttgcaggccttattcaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 915 - RNA, 2020 nt, synthetic construct
  misc_feature 1..2020: note = mRNA product Design a-2 comprising derived and/or modified sequence from HRSV(A2)__F0_DSCav1 (opt1)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 916 - RNA, 2020 nt, synthetic construct
  misc_feature 1..2020: note = mRNA product Design a-2 comprising derived and/or modified sequence from HRSV(A2)__F0_DSCav1 (opt1)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 917 - RNA, 2020 nt, synthetic construct
  misc_feature 1..2020: note = mRNA product Design a-2 comprising derived and/or modified sequence from HRSV(A2)__F0_DSCav1 (opt2)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 918 - RNA, 2020 nt, synthetic construct
  misc_feature 1..2020: note = mRNA product Design a-2 comprising derived and/or modified sequence from HRSV(A2)__F0_DSCav1 (opt3)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 919 - RNA, 2020 nt, synthetic construct
  misc_feature 1..2020: note = mRNA product Design a-2 comprising derived and/or modified sequence from HRSV(A2)__F0_DSCav1 (opt4)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 920 - RNA, 2020 nt, synthetic construct
  misc_feature 1..2020: note = mRNA product Design a-2 comprising derived and/or modified sequence from HRSV(A2)__F0_DSCav1 (opt5)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 921 - RNA, 2020 nt, synthetic construct
  misc_feature 1..2020: note = mRNA product Design a-2 comprising derived and/or modified sequence from HRSV(A2)__F0_DSCav1 (opt6)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 922 - RNA, 2020 nt, synthetic construct
  misc_feature 1..2020: note = mRNA product Design a-2 comprising derived and/or modified sequence from HRSV(A2)__F0_DSCav1 (opt11)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 923 - RNA, 2098 nt, synthetic construct
  misc_feature 1..2098: note = mRNA product Design a-3 comprising derived and/or modified sequence from HRSV(A2)__F0_DSCav1 (opt1)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 924 - RNA, 2098 nt, synthetic construct
  misc_feature 1..2098: note = mRNA product Design a-3 comprising derived and/or modified sequence from HRSV(A2)__F0_DSCav1 (opt1)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 925 - RNA, 2098 nt, synthetic construct
  misc_feature 1..2098: note = mRNA product Design a-3 comprising derived and/or modified sequence from HRSV(A2)__F0_DSCav1 (opt2)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 926 - RNA, 2098 nt, synthetic construct
  misc_feature 1..2098: note = mRNA product Design a-3 comprising derived and/or modified sequence from HRSV(A2)__F0_DSCav1 (opt3)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 927 - RNA, 2098 nt, synthetic construct
  misc_feature 1..2098: note = mRNA product Design a-3 comprising derived and/or modified sequence from HRSV(A2)__F0_DSCav1 (opt4)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 928 - RNA, 2098 nt, synthetic construct
  misc_feature 1..2098: note = mRNA product Design a-3 comprising derived and/or modified sequence from HRSV(A2)__F0_DSCav1 (opt5)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 929 - RNA, 2098 nt, synthetic construct
  misc_feature 1..2098: note = mRNA product Design a-3 comprising derived and/or modified sequence from HRSV(A2)__F0_DSCav1 (opt6)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 930 - RNA, 2098 nt, synthetic construct
  misc_feature 1..2098: note = mRNA product Design a-3 comprising derived and/or modified sequence from HRSV(A2)__F0_DSCav1 (opt11)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 931 - RNA, 2047 nt, synthetic construct
  misc_feature 1..2047: note = mRNA product Design a-4 comprising derived and/or modified sequence from HRSV(A2)__F0_DSCav1 (opt1)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 932 - RNA, 2047 nt, synthetic construct
  misc_feature 1..2047: note = mRNA product Design a-4 comprising derived and/or modified sequence from HRSV(A2)__F0_DSCav1 (opt1)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 933 - RNA, 2047 nt, synthetic construct
  misc_feature 1..2047: note = mRNA product Design a-4 comprising derived and/or modified sequence from HRSV(A2)__F0_DSCav1 (opt2)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 934 - RNA, 2047 nt, synthetic construct
  misc_feature 1..2047: note = mRNA product Design a-4 comprising derived and/or modified sequence from HRSV(A2)__F0_DSCav1 (opt3)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 935 - RNA, 2047 nt, synthetic construct
  misc_feature 1..2047: note = mRNA product Design a-4 comprising derived and/or modified sequence from HRSV(A2)__F0_DSCav1 (opt4)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 936 - RNA, 2047 nt, synthetic construct
  misc_feature 1..2047: note = mRNA product Design a-4 comprising derived and/or modified sequence from HRSV(A2)__F0_DSCav1 (opt5)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 937 - RNA, 2047 nt, synthetic construct
  misc_feature 1..2047: note = mRNA product Design a-4 comprising derived and/or modified sequence from HRSV(A2)__F0_DSCav1 (opt6)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 938 - RNA, 2047 nt, synthetic construct
  misc_feature 1..2047: note = mRNA product Design a-4 comprising derived and/or modified sequence from HRSV(A2)__F0_DSCav1 (opt11)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 939 - RNA, 1993 nt, synthetic construct
  misc_feature 1..1993: note = mRNA product Design a-5 comprising derived and/or modified sequence from HRSV(A2)__F0_DSCav1 (opt1)
  source 1..1993: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 940 - RNA, 1993 nt, synthetic construct
  misc_feature 1..1993: note = mRNA product Design a-5 comprising derived and/or modified sequence from HRSV(A2)__F0_DSCav1 (opt1)
  source 1..1993: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 941 - RNA, 1993 nt, synthetic construct
  misc_feature 1..1993: note = mRNA product Design a-5 comprising derived and/or modified sequence from HRSV(A2)__F0_DSCav1 (opt2)
  source 1..1993: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 942 - RNA, 1993 nt, synthetic construct
  misc_feature 1..1993: note = mRNA product Design a-5 comprising derived and/or modified sequence from HRSV(A2)__F0_DSCav1 (opt3)
  source 1..1993: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 943 - RNA, 1993 nt, synthetic construct
  misc_feature 1..1993: note = mRNA product Design a-5 comprising derived and/or modified sequence from HRSV(A2)__F0_DSCav1 (opt4)
  source 1..1993: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 944 - RNA, 1993 nt, synthetic construct
  misc_feature 1..1993: note = mRNA product Design a-5 comprising derived and/or modified sequence from HRSV(A2)__F0_DSCav1 (opt5)
  source 1..1993: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 945 - RNA, 1993 nt, synthetic construct
  misc_feature 1..1993: note = mRNA product Design a-5 comprising derived and/or modified sequence from HRSV(A2)__F0_DSCav1 (opt6)
  source 1..1993: mol_type = other RNA
gggagactttcccattctgtagcagaatttggtgttgcctgtggtcttggtcccgcggagaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 946 - RNA, 1993 nt, synthetic construct
  misc_feature 1..1993: note = mRNA product Design a-5 comprising derived and/or modified sequence from HRSV(A2)__F0_DSCav1 (opt11)
  source 1..1993: mol_type = other RNA
gggagactttcccattctgtagcagaatttggtgttgcctgtggtcttggtcccgcggagaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 947 - RNA, 2174 nt, synthetic construct
  misc_feature 1..2174: note = mRNA product Design b-1 comprising derived and/or modified sequence from HRSV(A2)__F0_DSCav1 (opt1)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 948 - RNA, 2174 nt, synthetic construct
  misc_feature 1..2174: note = mRNA product Design b-1 comprising derived and/or modified sequence from HRSV(A2)__F0_DSCav1 (opt1)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 949 - RNA, 2174 nt, synthetic construct
  misc_feature 1..2174: note = mRNA product Design b-1 comprising derived and/or modified sequence from HRSV(A2)__F0_DSCav1 (opt2)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 950 - RNA, 2174 nt, synthetic construct
  misc_feature 1..2174: note = mRNA product Design b-1 comprising derived and/or modified sequence from HRSV(A2)__F0_DSCav1 (opt3)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 951 - RNA, 2174 nt, synthetic construct
  misc_feature 1..2174: note = mRNA product Design b-1 comprising derived and/or modified sequence from HRSV(A2)__F0_DSCav1 (opt4)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 952 - RNA, 2174 nt, synthetic construct
  misc_feature 1..2174: note = mRNA product Design b-1 comprising derived and/or modified sequence from HRSV(A2)__F0_DSCav1 (opt5)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 953 - RNA, 2174 nt, synthetic construct
  misc_feature 1..2174: note = mRNA product Design b-1 comprising derived and/or modified sequence from HRSV(A2)__F0_DSCav1 (opt6)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 954 - RNA, 2174 nt, synthetic construct
  misc_feature 1..2174: note = mRNA product Design b-1 comprising derived and/or modified sequence from HRSV(A2)__F0_DSCav1 (opt11)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 955 - RNA, 1994 nt, synthetic construct
  misc_feature 1..1994: note = mRNA product Design b-2 comprising derived and/or modified sequence from HRSV(A2)__F0_DSCav1 (opt1)
  source 1..1994: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 956 - RNA, 1994 nt, synthetic construct
  misc_feature 1..1994: note = mRNA product Design b-2 comprising derived and/or modified sequence from HRSV(A2)__F0_DSCav1 (opt1)
  source 1..1994: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 957 - RNA, 1994 nt, synthetic construct
  misc_feature 1..1994: note = mRNA product Design b-2 comprising derived and/or modified sequence from HRSV(A2)__F0_DSCav1 (opt2)
  source 1..1994: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 958 - RNA, 1994 nt, synthetic construct
  misc_feature 1..1994: note = mRNA product Design b-2 comprising derived and/or modified sequence from HRSV(A2)__F0_DSCav1 (opt3)
  source 1..1994: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 959 - RNA, 1994 nt, synthetic construct
  misc_feature 1..1994: note = mRNA product Design b-2 comprising derived and/or modified sequence from HRSV(A2)__F0_DSCav1 (opt4)
  source 1..1994: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 960 - RNA, 1994 nt, synthetic construct
  misc_feature 1..1994: note = mRNA product Design b-2 comprising derived and/or modified sequence from HRSV(A2)__F0_DSCav1 (opt5)
  source 1..1994: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 961 - RNA, 1994 nt, synthetic construct
  misc_feature 1..1994: note = mRNA product Design b-2 comprising derived and/or modified sequence from HRSV(A2)__F0_DSCav1 (opt6)
  source 1..1994: mol_type = other RNA
gggagagcctctgctggagtccggggagtggcgttggctgctagagcgaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 962 - RNA, 1994 nt, synthetic construct
  misc_feature 1..1994: note = mRNA product Design b-2 comprising derived and/or modified sequence from HRSV(A2)__F0_DSCav1 (opt11)
  source 1..1994: mol_type = other RNA
gggagagcctctgctggagtccggggagtggcgttggctgctagagcgaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 963 - RNA, 2014 nt, synthetic construct
  misc_feature 1..2014: note = mRNA product Design b-3 comprising derived and/or modified sequence from HRSV(A2)__F0_DSCav1 (opt1)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 964 - RNA, 2014 nt, synthetic construct
  misc_feature 1..2014: note = mRNA product Design b-3 comprising derived and/or modified sequence from HRSV(A2)__F0_DSCav1 (opt1)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 965 - RNA, 2014 nt, synthetic construct
  misc_feature 1..2014: note = mRNA product Design b-3 comprising derived and/or modified sequence from HRSV(A2)__F0_DSCav1 (opt2)
  source 1..2014: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 966 - RNA, 2014 nt, synthetic construct
  misc_feature 1..2014: note = mRNA product Design b-3 comprising derived and/or modified sequence from HRSV(A2)__F0_DSCav1 (opt3)
  source 1..2014: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 967 - RNA, 2014 nt, synthetic construct
  misc_feature 1..2014: note = mRNA product Design b-3 comprising derived and/or modified sequence from HRSV(A2)__F0_DSCav1 (opt4)
  source 1..2014: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 968 - RNA, 2014 nt, synthetic construct
  misc_feature 1..2014: note = mRNA product Design b-3 comprising derived and/or modified sequence from HRSV(A2)__F0_DSCav1 (opt5)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 969 - RNA, 2014 nt, synthetic construct
  misc_feature 1..2014: note = mRNA product Design b-3 comprising derived and/or modified sequence from HRSV(A2)__F0_DSCav1 (opt6)
  source 1..2014: mol_type = other RNA
gggagagtcccgcagtcggcgtccagcggctctgcttgttcgtgtgtgtgtcgttgcaggccttattcaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 970 - RNA, 2014 nt, synthetic construct
  misc_feature 1..2014: note = mRNA product Design b-3 comprising derived and/or modified sequence from HRSV(A2)__F0_DSCav1 (opt11)
  source 1..2014: mol_type = other RNA
gggagagtcccgcagtcggcgtccagcggctctgcttgttcgtgtgtgtgtcgttgcaggccttattcaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 971 - RNA, 2065 nt, synthetic construct
  misc_feature 1..2065: note = mRNA product Design b-4 comprising derived and/or modified sequence from HRSV(A2)__F0_DSCav1 (opt1)
  source 1..2065: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 972 - RNA, 2065 nt, synthetic construct
  misc_feature 1..2065: note = mRNA product Design b-4 comprising derived and/or modified sequence from HRSV(A2)__F0_DSCav1 (opt1)
  source 1..2065: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 973 - RNA, 2065 nt, synthetic construct
  misc_feature 1..2065: note = mRNA product Design b-4 comprising derived and/or modified sequence from HRSV(A2)__F0_DSCav1 (opt2)
  source 1..2065: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 974 - RNA, 2065 nt, synthetic construct
  misc_feature 1..2065: note = mRNA product Design b-4 comprising derived and/or modified sequence from HRSV(A2)__F0_DSCav1 (opt3)
  source 1..2065: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 975 - RNA, 2065 nt, synthetic construct
  misc_feature 1..2065: note = mRNA product Design b-4 comprising derived and/or modified sequence from HRSV(A2)__F0_DSCav1 (opt4)
  source 1..2065: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 976 - RNA, 2065 nt, synthetic construct
  misc_feature 1..2065: note = mRNA product Design b-4 comprising derived and/or modified sequence from HRSV(A2)__F0_DSCav1 (opt5)
  source 1..2065: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 977 - RNA, 2065 nt, synthetic construct
  misc_feature 1..2065: note = mRNA product Design b-4 comprising derived and/or modified sequence from HRSV(A2)__F0_DSCav1 (opt6)
  source 1..2065: mol_type = other RNA
gggagagtcccgcagtcggcgtccagcggctctgcttgttcgtgtgtgtgtcgttgcaggccttattcaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 978 - RNA, 2065 nt, synthetic construct
  misc_feature 1..2065: note = mRNA product Design b-4 comprising derived and/or modified sequence from HRSV(A2)__F0_DSCav1 (opt11)
  source 1..2065: mol_type = other RNA
gggagagtcccgcagtcggcgtccagcggctctgcttgttcgtgtgtgtgtcgttgcaggccttattcaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 979 - RNA, 2127 nt, synthetic construct
  misc_feature 1..2127: note = mRNA product Design b-5 comprising derived and/or modified sequence from HRSV(A2)__F0_DSCav1 (opt1)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 980 - RNA, 2127 nt, synthetic construct
  misc_feature 1..2127: note = mRNA product Design b-5 comprising derived and/or modified sequence from HRSV(A2)__F0_DSCav1 (opt1)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 981 - RNA, 2127 nt, synthetic construct
  misc_feature 1..2127: note = mRNA product Design b-5 comprising derived and/or modified sequence from HRSV(A2)__F0_DSCav1 (opt2)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 982 - RNA, 2127 nt, synthetic construct
  misc_feature 1..2127: note = mRNA product Design b-5 comprising derived and/or modified sequence from HRSV(A2)__F0_DSCav1 (opt3)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 983 - RNA, 2127 nt, synthetic construct
  misc_feature 1..2127: note = mRNA product Design b-5 comprising derived and/or modified sequence from HRSV(A2)__F0_DSCav1 (opt4)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 984 - RNA, 2127 nt, synthetic construct
  misc_feature 1..2127: note = mRNA product Design b-5 comprising derived and/or modified sequence from HRSV(A2)__F0_DSCav1 (opt5)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 985 - RNA, 2127 nt, synthetic construct
  misc_feature 1..2127: note = mRNA product Design b-5 comprising derived and/or modified sequence from HRSV(A2)__F0_DSCav1 (opt6)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 986 - RNA, 2127 nt, synthetic construct
  misc_feature 1..2127: note = mRNA product Design b-5 comprising derived and/or modified sequence from HRSV(A2)__F0_DSCav1 (opt11)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 987 - RNA, 2033 nt, synthetic construct
  misc_feature 1..2033: note = mRNA product Design c-1 comprising derived and/or modified sequence from HRSV(A2)__F0_DSCav1 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 988 - RNA, 2033 nt, synthetic construct
  misc_feature 1..2033: note = mRNA product Design c-1 comprising derived and/or modified sequence from HRSV(A2)__F0_DSCav1 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 989 - RNA, 2033 nt, synthetic construct
  misc_feature 1..2033: note = mRNA product Design c-1 comprising derived and/or modified sequence from HRSV(A2)__F0_DSCav1 (opt2)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 990 - RNA, 2033 nt, synthetic construct
  misc_feature 1..2033: note = mRNA product Design c-1 comprising derived and/or modified sequence from HRSV(A2)__F0_DSCav1 (opt3)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 991 - RNA, 2033 nt, synthetic construct
  misc_feature 1..2033: note = mRNA product Design c-1 comprising derived and/or modified sequence from HRSV(A2)__F0_DSCav1 (opt4)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 992 - RNA, 2033 nt, synthetic construct
  misc_feature 1..2033: note = mRNA product Design c-1 comprising derived and/or modified sequence from HRSV(A2)__F0_DSCav1 (opt5)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 993 - RNA, 2033 nt, synthetic construct
  misc_feature 1..2033: note = mRNA product Design c-1 comprising derived and/or modified sequence from HRSV(A2)__F0_DSCav1 (opt6)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 994 - RNA, 2033 nt, synthetic construct
  misc_feature 1..2033: note = mRNA product Design c-1 comprising derived and/or modified sequence from HRSV(A2)__F0_DSCav1 (opt11)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 995 - RNA, 2123 nt, synthetic construct
  misc_feature 1..2123: note = mRNA product Design c-2 comprising derived and/or modified sequence from HRSV(A2)__F0_DSCav1 (opt1)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 996 - RNA, 2123 nt, synthetic construct
  misc_feature 1..2123: note = mRNA product Design c-2 comprising derived and/or modified sequence from HRSV(A2)__F0_DSCav1 (opt1)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 997 - RNA, 2123 nt, synthetic construct
  misc_feature 1..2123: note = mRNA product Design c-2 comprising derived and/or modified sequence from HRSV(A2)__F0_DSCav1 (opt2)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 998 - RNA, 2123 nt, synthetic construct
  misc_feature 1..2123: note = mRNA product Design c-2 comprising derived and/or modified sequence from HRSV(A2)__F0_DSCav1 (opt3)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 999 - RNA, 2123 nt, synthetic construct
  misc_feature 1..2123: note = mRNA product Design c-2 comprising derived and/or modified sequence from HRSV(A2)__F0_DSCav1 (opt4)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1000 - RNA, 2123 nt, synthetic construct
  misc_feature 1..2123: note = mRNA product Design c-2 comprising derived and/or modified sequence from HRSV(A2)__F0_DSCav1 (opt5)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1001 - RNA, 2123 nt, synthetic construct
  misc_feature 1..2123: note = mRNA product Design c-2 comprising derived and/or modified sequence from HRSV(A2)__F0_DSCav1 (opt6)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1002 - RNA, 2123 nt, synthetic construct
  misc_feature 1..2123: note = mRNA product Design c-2 comprising derived and/or modified sequence from HRSV(A2)__F0_DSCav1 (opt11)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1003 - RNA, 2100 nt, synthetic construct
  misc_feature 1..2100: note = mRNA product Design c-3 comprising derived and/or modified sequence from HRSV(A2)__F0_DSCav1 (opt1)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1004 - RNA, 2100 nt, synthetic construct
  misc_feature 1..2100: note = mRNA product Design c-3 comprising derived and/or modified sequence from HRSV(A2)__F0_DSCav1 (opt1)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1005 - RNA, 2100 nt, synthetic construct
  misc_feature 1..2100: note = mRNA product Design c-3 comprising derived and/or modified sequence from HRSV(A2)__F0_DSCav1 (opt2)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1006 - RNA, 2100 nt, synthetic construct
  misc_feature 1..2100: note = mRNA product Design c-3 comprising derived and/or modified sequence from HRSV(A2)__F0_DSCav1 (opt3)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1007 - RNA, 2100 nt, synthetic construct
  misc_feature 1..2100: note = mRNA product Design c-3 comprising derived and/or modified sequence from HRSV(A2)__F0_DSCav1 (opt4)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1008 - RNA, 2100 nt, synthetic construct
  misc_feature 1..2100: note = mRNA product Design c-3 comprising derived and/or modified sequence from HRSV(A2)__F0_DSCav1 (opt5)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1009 - RNA, 2100 nt, synthetic construct
  misc_feature 1..2100: note = mRNA product Design c-3 comprising derived and/or modified sequence from HRSV(A2)__F0_DSCav1 (opt6)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1010 - RNA, 2100 nt, synthetic construct
  misc_feature 1..2100: note = mRNA product Design c-3 comprising derived and/or modified sequence from HRSV(A2)__F0_DSCav1 (opt11)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1011 - RNA, 2096 nt, synthetic construct
  misc_feature 1..2096: note = mRNA product Design c-4 comprising derived and/or modified sequence from HRSV(A2)__F0_DSCav1 (opt1)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1012 - RNA, 2096 nt, synthetic construct
  misc_feature 1..2096: note = mRNA product Design c-4 comprising derived and/or modified sequence from HRSV(A2)__F0_DSCav1 (opt1)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1013 - RNA, 2096 nt, synthetic construct
  misc_feature 1..2096: note = mRNA product Design c-4 comprising derived and/or modified sequence from HRSV(A2)__F0_DSCav1 (opt2)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1014 - RNA, 2096 nt, synthetic construct
  misc_feature 1..2096: note = mRNA product Design c-4 comprising derived and/or modified sequence from HRSV(A2)__F0_DSCav1 (opt3)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1015 - RNA, 2096 nt, synthetic construct
  misc_feature 1..2096: note = mRNA product Design c-4 comprising derived and/or modified sequence from HRSV(A2)__F0_DSCav1 (opt4)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1016 - RNA, 2096 nt, synthetic construct
  misc_feature 1..2096: note = mRNA product Design c-4 comprising derived and/or modified sequence from HRSV(A2)__F0_DSCav1 (opt5)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1017 - RNA, 2096 nt, synthetic construct
  misc_feature 1..2096: note = mRNA product Design c-4 comprising derived and/or modified sequence from HRSV(A2)__F0_DSCav1 (opt6)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1018 - RNA, 2096 nt, synthetic construct
  misc_feature 1..2096: note = mRNA product Design c-4 comprising derived and/or modified sequence from HRSV(A2)__F0_DSCav1 (opt11)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1019 - RNA, 2014 nt, synthetic construct
  misc_feature 1..2014: note = mRNA product Design c-5 comprising derived and/or modified sequence from HRSV(A2)__F0_DSCav1 (opt1)
  source 1..2014: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1020 - RNA, 2014 nt, synthetic construct
  misc_feature 1..2014: note = mRNA product Design c-5 comprising derived and/or modified sequence from HRSV(A2)__F0_DSCav1 (opt1)
  source 1..2014: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1021 - RNA, 2014 nt, synthetic construct
  misc_feature 1..2014: note = mRNA product Design c-5 comprising derived and/or modified sequence from HRSV(A2)__F0_DSCav1 (opt2)
  source 1..2014: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1022 - RNA, 2014 nt, synthetic construct
  misc_feature 1..2014: note = mRNA product Design c-5 comprising derived and/or modified sequence from HRSV(A2)__F0_DSCav1 (opt3)
  source 1..2014: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1023 - RNA, 2014 nt, synthetic construct
  misc_feature 1..2014: note = mRNA product Design c-5 comprising derived and/or modified sequence from HRSV(A2)__F0_DSCav1 (opt4)
  source 1..2014: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1024 - RNA, 2014 nt, synthetic construct
  misc_feature 1..2014: note = mRNA product Design c-5 comprising derived and/or modified sequence from HRSV(A2)__F0_DSCav1 (opt5)
  source 1..2014: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1025 - RNA, 2014 nt, synthetic construct
  misc_feature 1..2014: note = mRNA product Design c-5 comprising derived and/or modified sequence from HRSV(A2)__F0_DSCav1 (opt6)
  source 1..2014: mol_type = other RNA
gggagagcggctcggccattttgtcccagtcagtccggaggctgcggctgcagaagtaccgcctgcggagtaactgcaaagaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1026 - RNA, 2014 nt, synthetic construct
  misc_feature 1..2014: note = mRNA product Design c-5 comprising derived and/or modified sequence from HRSV(A2)__F0_DSCav1 (opt11)
  source 1..2014: mol_type = other RNA
gggagagcggctcggccattttgtcccagtcagtccggaggctgcggctgcagaagtaccgcctgcggagtaactgcaaagaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1027 - RNA, 2023 nt, synthetic construct
  misc_feature 1..2023: note = mRNA product Design d-1 comprising derived and/or modified sequence from HRSV(A2)__F0_DSCav1 (opt1)
  source 1..2023: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1028 - RNA, 2023 nt, synthetic construct
  misc_feature 1..2023: note = mRNA product Design d-1 comprising derived and/or modified sequence from HRSV(A2)__F0_DSCav1 (opt1)
  source 1..2023: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1029 - RNA, 2023 nt, synthetic construct
  misc_feature 1..2023: note = mRNA product Design d-1 comprising derived and/or modified sequence from HRSV(A2)__F0_DSCav1 (opt2)
  source 1..2023: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1030 - RNA, 2023 nt, synthetic construct
  misc_feature 1..2023: note = mRNA product Design d-1 comprising derived and/or modified sequence from HRSV(A2)__F0_DSCav1 (opt3)
  source 1..2023: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1031 - RNA, 2023 nt, synthetic construct
  misc_feature 1..2023: note = mRNA product Design d-1 comprising derived and/or modified sequence from HRSV(A2)__F0_DSCav1 (opt4)
  source 1..2023: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1032 - RNA, 2023 nt, synthetic construct
  misc_feature 1..2023: note = mRNA product Design d-1 comprising derived and/or modified sequence from HRSV(A2)__F0_DSCav1 (opt5)
  source 1..2023: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1033 - RNA, 2023 nt, synthetic construct
  misc_feature 1..2023: note = mRNA product Design d-1 comprising derived and/or modified sequence from HRSV(A2)__F0_DSCav1 (opt6)
  source 1..2023: mol_type = other RNA
gggagacccgtgacccggaagttgtacggctacgcgactttccctcccacaaaccctcgcgcccttcctttcctacttgggcccggcagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1034 - RNA, 2023 nt, synthetic construct
  misc_feature 1..2023: note = mRNA product Design d-1 comprising derived and/or modified sequence from HRSV(A2)__F0_DSCav1 (opt11)
  source 1..2023: mol_type = other RNA
gggagacccgtgacccggaagttgtacggctacgcgactttccctcccacaaaccctcgcgcccttcctttcctacttgggcccggcagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1035 - RNA, 2078 nt, synthetic construct
  misc_feature 1..2078: note = mRNA product Design d-2 comprising derived and/or modified sequence from HRSV(A2)__F0_DSCav1 (opt1)
  source 1..2078: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1036 - RNA, 2078 nt, synthetic construct
  misc_feature 1..2078: note = mRNA product Design d-2 comprising derived and/or modified sequence from HRSV(A2)__F0_DSCav1 (opt1)
  source 1..2078: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1037 - RNA, 2078 nt, synthetic construct
  misc_feature 1..2078: note = mRNA product Design d-2 comprising derived and/or modified sequence from HRSV(A2)__F0_DSCav1 (opt2)
  source 1..2078: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1038 - RNA, 2078 nt, synthetic construct
  misc_feature 1..2078: note = mRNA product Design d-2 comprising derived and/or modified sequence from HRSV(A2)__F0_DSCav1 (opt3)
  source 1..2078: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1039 - RNA, 2078 nt, synthetic construct
  misc_feature 1..2078: note = mRNA product Design d-2 comprising derived and/or modified sequence from HRSV(A2)__F0_DSCav1 (opt4)
  source 1..2078: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1040 - RNA, 2078 nt, synthetic construct
  misc_feature 1..2078: note = mRNA product Design d-2 comprising derived and/or modified sequence from HRSV(A2)__F0_DSCav1 (opt5)
  source 1..2078: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1041 - RNA, 2078 nt, synthetic construct
  misc_feature 1..2078: note = mRNA product Design d-2 comprising derived and/or modified sequence from HRSV(A2)__F0_DSCav1 (opt6)
  source 1..2078: mol_type = other RNA
gggagagcggctcggccattttgtcccagtcagtccggaggctgcggctgcagaagtaccgcctgcggagtaactgcaaagaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1042 - RNA, 2078 nt, synthetic construct
  misc_feature 1..2078: note = mRNA product Design d-2 comprising derived and/or modified sequence from HRSV(A2)__F0_DSCav1 (opt11)
  source 1..2078: mol_type = other RNA
gggagagcggctcggccattttgtcccagtcagtccggaggctgcggctgcagaagtaccgcctgcggagtaactgcaaagaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1043 - RNA, 2394 nt, synthetic construct
  misc_feature 1..2394: note = mRNA product Design d-3 comprising derived and/or modified sequence from HRSV(A2)__F0_DSCav1 (opt1)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1044 - RNA, 2394 nt, synthetic construct
  misc_feature 1..2394: note = mRNA product Design d-3 comprising derived and/or modified sequence from HRSV(A2)__F0_DSCav1 (opt1)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1045 - RNA, 2394 nt, synthetic construct
  misc_feature 1..2394: note = mRNA product Design d-3 comprising derived and/or modified sequence from HRSV(A2)__F0_DSCav1 (opt2)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1046 - RNA, 2394 nt, synthetic construct
  misc_feature 1..2394: note = mRNA product Design d-3 comprising derived and/or modified sequence from HRSV(A2)__F0_DSCav1 (opt3)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1047 - RNA, 2394 nt, synthetic construct
  misc_feature 1..2394: note = mRNA product Design d-3 comprising derived and/or modified sequence from HRSV(A2)__F0_DSCav1 (opt4)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1048 - RNA, 2394 nt, synthetic construct
  misc_feature 1..2394: note = mRNA product Design d-3 comprising derived and/or modified sequence from HRSV(A2)__F0_DSCav1 (opt5)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1049 - RNA, 2394 nt, synthetic construct
  misc_feature 1..2394: note = mRNA product Design d-3 comprising derived and/or modified sequence from HRSV(A2)__F0_DSCav1 (opt6)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1050 - RNA, 2394 nt, synthetic construct
  misc_feature 1..2394: note = mRNA product Design d-3 comprising derived and/or modified sequence from HRSV(A2)__F0_DSCav1 (opt11)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1051 - RNA, 2077 nt, synthetic construct
  misc_feature 1..2077: note = mRNA product Design d-4 comprising derived and/or modified sequence from HRSV(A2)__F0_DSCav1 (opt1)
  source 1..2077: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1052 - RNA, 2077 nt, synthetic construct
  misc_feature 1..2077: note = mRNA product Design d-4 comprising derived and/or modified sequence from HRSV(A2)__F0_DSCav1 (opt1)
  source 1..2077: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1053 - RNA, 2077 nt, synthetic construct
  misc_feature 1..2077: note = mRNA product Design d-4 comprising derived and/or modified sequence from HRSV(A2)__F0_DSCav1 (opt2)
  source 1..2077: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1054 - RNA, 2077 nt, synthetic construct
  misc_feature 1..2077: note = mRNA product Design d-4 comprising derived and/or modified sequence from HRSV(A2)__F0_DSCav1 (opt3)
  source 1..2077: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1055 - RNA, 2077 nt, synthetic construct
  misc_feature 1..2077: note = mRNA product Design d-4 comprising derived and/or modified sequence from HRSV(A2)__F0_DSCav1 (opt4)
  source 1..2077: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1056 - RNA, 2077 nt, synthetic construct
  misc_feature 1..2077: note = mRNA product Design d-4 comprising derived and/or modified sequence from HRSV(A2)__F0_DSCav1 (opt5)
  source 1..2077: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1057 - RNA, 2077 nt, synthetic construct
  misc_feature 1..2077: note = mRNA product Design d-4 comprising derived and/or modified sequence from HRSV(A2)__F0_DSCav1 (opt6)
  source 1..2077: mol_type = other RNA
gggagagtcccgcagtcggcgtccagcggctctgcttgttcgtgtgtgtgtcgttgcaggccttattcaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1058 - RNA, 2077 nt, synthetic construct
  misc_feature 1..2077: note = mRNA product Design d-4 comprising derived and/or modified sequence from HRSV(A2)__F0_DSCav1 (opt11)
  source 1..2077: mol_type = other RNA
gggagagtcccgcagtcggcgtccagcggctctgcttgttcgtgtgtgtgtcgttgcaggccttattcaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1059 - RNA, 2174 nt, synthetic construct
  misc_feature 1..2174: note = mRNA product Design d-5 comprising derived and/or modified sequence from HRSV(A2)__F0_DSCav1 (opt1)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1060 - RNA, 2174 nt, synthetic construct
  misc_feature 1..2174: note = mRNA product Design d-5 comprising derived and/or modified sequence from HRSV(A2)__F0_DSCav1 (opt1)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1061 - RNA, 2174 nt, synthetic construct
  misc_feature 1..2174: note = mRNA product Design d-5 comprising derived and/or modified sequence from HRSV(A2)__F0_DSCav1 (opt2)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1062 - RNA, 2174 nt, synthetic construct
  misc_feature 1..2174: note = mRNA product Design d-5 comprising derived and/or modified sequence from HRSV(A2)__F0_DSCav1 (opt3)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1063 - RNA, 2174 nt, synthetic construct
  misc_feature 1..2174: note = mRNA product Design d-5 comprising derived and/or modified sequence from HRSV(A2)__F0_DSCav1 (opt4)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1064 - RNA, 2174 nt, synthetic construct
  misc_feature 1..2174: note = mRNA product Design d-5 comprising derived and/or modified sequence from HRSV(A2)__F0_DSCav1 (opt5)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1065 - RNA, 2174 nt, synthetic construct
  misc_feature 1..2174: note = mRNA product Design d-5 comprising derived and/or modified sequence from HRSV(A2)__F0_DSCav1 (opt6)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1066 - RNA, 2174 nt, synthetic construct
  misc_feature 1..2174: note = mRNA product Design d-5 comprising derived and/or modified sequence from HRSV(A2)__F0_DSCav1 (opt11)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1067 - RNA, 2054 nt, synthetic construct
  misc_feature 1..2054: note = mRNA product Design e-1 comprising derived and/or modified sequence from HRSV(A2)__F0_DSCav1 (opt1)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1068 - RNA, 2054 nt, synthetic construct
  misc_feature 1..2054: note = mRNA product Design e-1 comprising derived and/or modified sequence from HRSV(A2)__F0_DSCav1 (opt1)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1069 - RNA, 2054 nt, synthetic construct
  misc_feature 1..2054: note = mRNA product Design e-1 comprising derived and/or modified sequence from HRSV(A2)__F0_DSCav1 (opt2)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1070 - RNA, 2054 nt, synthetic construct
  misc_feature 1..2054: note = mRNA product Design e-1 comprising derived and/or modified sequence from HRSV(A2)__F0_DSCav1 (opt3)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1071 - RNA, 2054 nt, synthetic construct
  misc_feature 1..2054: note = mRNA product Design e-1 comprising derived and/or modified sequence from HRSV(A2)__F0_DSCav1 (opt4)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1072 - RNA, 2054 nt, synthetic construct
  misc_feature 1..2054: note = mRNA product Design e-1 comprising derived and/or modified sequence from HRSV(A2)__F0_DSCav1 (opt5)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1073 - RNA, 2054 nt, synthetic construct
  misc_feature 1..2054: note = mRNA product Design e-1 comprising derived and/or modified sequence from HRSV(A2)__F0_DSCav1 (opt6)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1074 - RNA, 2054 nt, synthetic construct
  misc_feature 1..2054: note = mRNA product Design e-1 comprising derived and/or modified sequence from HRSV(A2)__F0_DSCav1 (opt11)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1075 - RNA, 2036 nt, synthetic construct
  misc_feature 1..2036: note = mRNA product Design e-2 comprising derived and/or modified sequence from HRSV(A2)__F0_DSCav1 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1076 - RNA, 2036 nt, synthetic construct
  misc_feature 1..2036: note = mRNA product Design e-2 comprising derived and/or modified sequence from HRSV(A2)__F0_DSCav1 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1077 - RNA, 2036 nt, synthetic construct
  misc_feature 1..2036: note = mRNA product Design e-2 comprising derived and/or modified sequence from HRSV(A2)__F0_DSCav1 (opt2)
  source 1..2036: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1078 - RNA, 2036 nt, synthetic construct
  misc_feature 1..2036: note = mRNA product Design e-2 comprising derived and/or modified sequence from HRSV(A2)__F0_DSCav1 (opt3)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1079 - RNA, 2036 nt, synthetic construct
  misc_feature 1..2036: note = mRNA product Design e-2 comprising derived and/or modified sequence from HRSV(A2)__F0_DSCav1 (opt4)
  source 1..2036: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1080 - RNA, 2036 nt, synthetic construct
  misc_feature 1..2036: note = mRNA product Design e-2 comprising derived and/or modified sequence from HRSV(A2)__F0_DSCav1 (opt5)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1081 - RNA, 2036 nt, synthetic construct
  misc_feature 1..2036: note = mRNA product Design e-2 comprising derived and/or modified sequence from HRSV(A2)__F0_DSCav1 (opt6)
  source 1..2036: mol_type = other RNA
gggagacccgtgacccggaagttgtacggctacgcgactttccctcccacaaaccctcgcgcccttcctttcctacttgggcccggcagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1082 - RNA, 2036 nt, synthetic construct
  misc_feature 1..2036: note = mRNA product Design e-2 comprising derived and/or modified sequence from HRSV(A2)__F0_DSCav1 (opt11)
  source 1..2036: mol_type = other RNA
gggagacccgtgacccggaagttgtacggctacgcgactttccctcccacaaaccctcgcgcccttcctttcctacttgggcccggcagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1083 - RNA, 2006 nt, synthetic construct
  misc_feature 1..2006: note = mRNA product Design e-3 comprising derived and/or modified sequence from HRSV(A2)__F0_DSCav1 (opt1)
  source 1..2006: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1084 - RNA, 2006 nt, synthetic construct
  misc_feature 1..2006: note = mRNA product Design e-3 comprising derived and/or modified sequence from HRSV(A2)__F0_DSCav1 (opt1)
  source 1..2006: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1085 - RNA, 2006 nt, synthetic construct
  misc_feature 1..2006: note = mRNA product Design e-3 comprising derived and/or modified sequence from HRSV(A2)__F0_DSCav1 (opt2)
  source 1..2006: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1086 - RNA, 2006 nt, synthetic construct
  misc_feature 1..2006: note = mRNA product Design e-3 comprising derived and/or modified sequence from HRSV(A2)__F0_DSCav1 (opt3)
  source 1..2006: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1087 - RNA, 2006 nt, synthetic construct
  misc_feature 1..2006: note = mRNA product Design e-3 comprising derived and/or modified sequence from HRSV(A2)__F0_DSCav1 (opt4)
  source 1..2006: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1088 - RNA, 2006 nt, synthetic construct
  misc_feature 1..2006: note = mRNA product Design e-3 comprising derived and/or modified sequence from HRSV(A2)__F0_DSCav1 (opt5)
  source 1..2006: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1089 - RNA, 2006 nt, synthetic construct
  misc_feature 1..2006: note = mRNA product Design e-3 comprising derived and/or modified sequence from HRSV(A2)__F0_DSCav1 (opt6)
  source 1..2006: mol_type = other RNA
gggagactttcccattctgtagcagaatttggtgttgcctgtggtcttggtcccgcggagaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1090 - RNA, 2006 nt, synthetic construct
  misc_feature 1..2006: note = mRNA product Design e-3 comprising derived and/or modified sequence from HRSV(A2)__F0_DSCav1 (opt11)
  source 1..2006: mol_type = other RNA
gggagactttcccattctgtagcagaatttggtgttgcctgtggtcttggtcccgcggagaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1091 - RNA, 2060 nt, synthetic construct
  misc_feature 1..2060: note = mRNA product Design e-4 comprising derived and/or modified sequence from HRSV(A2)__F0_DSCav1 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1092 - RNA, 2060 nt, synthetic construct
  misc_feature 1..2060: note = mRNA product Design e-4 comprising derived and/or modified sequence from HRSV(A2)__F0_DSCav1 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1093 - RNA, 2060 nt, synthetic construct
  misc_feature 1..2060: note = mRNA product Design e-4 comprising derived and/or modified sequence from HRSV(A2)__F0_DSCav1 (opt2)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1094 - RNA, 2060 nt, synthetic construct
  misc_feature 1..2060: note = mRNA product Design e-4 comprising derived and/or modified sequence from HRSV(A2)__F0_DSCav1 (opt3)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1095 - RNA, 2060 nt, synthetic construct
  misc_feature 1..2060: note = mRNA product Design e-4 comprising derived and/or modified sequence from HRSV(A2)__F0_DSCav1 (opt4)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1096 - RNA, 2060 nt, synthetic construct
  misc_feature 1..2060: note = mRNA product Design e-4 comprising derived and/or modified sequence from HRSV(A2)__F0_DSCav1 (opt5)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1097 - RNA, 2060 nt, synthetic construct
  misc_feature 1..2060: note = mRNA product Design e-4 comprising derived and/or modified sequence from HRSV(A2)__F0_DSCav1 (opt6)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1098 - RNA, 2060 nt, synthetic construct
  misc_feature 1..2060: note = mRNA product Design e-4 comprising derived and/or modified sequence from HRSV(A2)__F0_DSCav1 (opt11)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1099 - RNA, 2027 nt, synthetic construct
  misc_feature 1..2027: note = mRNA product Design e-5 comprising derived and/or modified sequence from HRSV(A2)__F0_DSCav1 (opt1)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1100 - RNA, 2027 nt, synthetic construct
  misc_feature 1..2027: note = mRNA product Design e-5 comprising derived and/or modified sequence from HRSV(A2)__F0_DSCav1 (opt1)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1101 - RNA, 2027 nt, synthetic construct
  misc_feature 1..2027: note = mRNA product Design e-5 comprising derived and/or modified sequence from HRSV(A2)__F0_DSCav1 (opt2)
  source 1..2027: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1102 - RNA, 2027 nt, synthetic construct
  misc_feature 1..2027: note = mRNA product Design e-5 comprising derived and/or modified sequence from HRSV(A2)__F0_DSCav1 (opt3)
  source 1..2027: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1103 - RNA, 2027 nt, synthetic construct
  misc_feature 1..2027: note = mRNA product Design e-5 comprising derived and/or modified sequence from HRSV(A2)__F0_DSCav1 (opt4)
  source 1..2027: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1104 - RNA, 2027 nt, synthetic construct
  misc_feature 1..2027: note = mRNA product Design e-5 comprising derived and/or modified sequence from HRSV(A2)__F0_DSCav1 (opt5)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1105 - RNA, 2027 nt, synthetic construct
  misc_feature 1..2027: note = mRNA product Design e-5 comprising derived and/or modified sequence from HRSV(A2)__F0_DSCav1 (opt6)
  source 1..2027: mol_type = other RNA
gggagagcggctcggccattttgtcccagtcagtccggaggctgcggctgcagaagtaccgcctgcggagtaactgcaaagaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1106 - RNA, 2027 nt, synthetic construct
  misc_feature 1..2027: note = mRNA product Design e-5 comprising derived and/or modified sequence from HRSV(A2)__F0_DSCav1 (opt11)
  source 1..2027: mol_type = other RNA
gggagagcggctcggccattttgtcccagtcagtccggaggctgcggctgcagaagtaccgcctgcggagtaactgcaaagaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

(The sequence listing continues in the following parts.)

The invention claimed is:

1. A purified RNA molecule, said RNA molecule comprising:
   a) a 5'-cap structure;
   b) a heterologous 5' untranslated region (UTR);
   c) at least one coding sequence encoding an antigenic RSV F protein having an amino acid sequence that is at least 97% identical to the amino acid sequence of SEQ ID NO: 4957, wherein said at least one coding sequence is at least 90% identical to the RNA sequence of SEQ ID NO: 4962; and
   d) at least one poly(A) sequence comprising 30 to 150 consecutive adenosine nucleotides.

2. The purified RNA molecule of claim 1, further comprising a heterologous 3' UTR.

3. The purified RNA molecule of claim 2, wherein the heterologous 3'-UTR is derived from a 3'-UTR of an alpha-globin gene.

4. The purified RNA molecule of claim 1, wherein the 5'-cap structure is a Cap1.

5. The purified RNA molecule of claim 2, wherein the antigenic RSV F protein has an amino acid sequence that is at least 98% identical to the amino acid sequence of SEQ ID NO: 4957.

6. The purified RNA molecule of claim 1, wherein the RNA molecule comprises at least one chemically modified nucleotide.

7. The purified RNA molecule of claim 1, wherein all uracil nucleotides of the RNA molecule are replaced by N1-methylpseudouridine (m1ψ) nucleotides.

8. The purified RNA molecule of claim 7, wherein the RNA molecule is a mRNA molecule.

9. The purified RNA molecule of claim 1, wherein the RNA molecule is a self-replicating RNA molecule.

10. The purified RNA molecule of claim 1, wherein the at least one poly(A) sequence is located at the 3' terminus of the RNA molecule.

11. The purified RNA molecule of claim 1, wherein the amino acid sequence of the antigenic RSV F protein comprises the following amino acid substitutions relative to the amino acid sequence of a native RSV F protein: S155C, S290C, S190F, V207L, A149C and Y458C.

12. The purified RNA molecule of claim 11, wherein the amino acid sequence of the antigenic RSV F protein comprises a GS linker in place of amino acids 104-144 of the amino acid sequence of the native RSV F protein.

13. The purified RNA molecule of claim 12, wherein the amino acid sequence of the antigenic RSV F protein lacks amino acids 554-574 of the amino acid sequence of the native RSV F protein.

14. The purified RNA molecule of claim 12, wherein the antigenic RSV F protein comprises the native RSV F protein transmembrane domain.

15. A pharmaceutical composition comprising purified RNA molecules of claim 8 formulated in a pharmaceutically acceptable carrier.

16. The pharmaceutical composition of claim 15, wherein the RNA molecules are formulated with lipid nanoparticles (LNPs).

17. The pharmaceutical composition of claim 16, wherein the LNPs comprise a cationic lipid.

18. The pharmaceutical composition of claim 17, wherein the LNPs comprise a cationic lipid, a neutral lipid, a sterol, and a polymer conjugated lipid.

19. The pharmaceutical composition of claim 18, wherein the LNPs comprise a cationic lipid, a neutral lipid, a sterol, and a PEG-lipid.

20. The pharmaceutical composition of claim 19, wherein the LNPs comprise a molar ratio of about 20-60% cationic lipid, 5-25% neutral lipid, 25-55% sterol, and 0.5-15% PEG-lipid.

21. The pharmaceutical composition of claim 18, wherein the amino acid sequence of the antigenic RSV F protein comprises the following amino acid substitutions relative to the amino acid sequence of a native RSV F protein: S155C, S290C, S190F, V207L, A149C and Y458C.

22. The pharmaceutical composition of claim 21, wherein the amino acid sequence of the antigenic RSV F protein comprises a GS linker in place of amino acids 104-144 of the amino acid sequence of the native RSV F protein.

23. The pharmaceutical composition of claim 22, wherein the amino acid sequence of the antigenic RSV F protein lacks amino acids 554-574 of the amino acid sequence of the native RSV F protein.

24. The pharmaceutical composition of claim 23, wherein the antigenic RSV F protein comprises the native RSV F protein transmembrane domain.

25. A method of stimulating an anti-RSV immune response in a subject comprising administering to the subject the pharmaceutical composition of claim 20.

26. The method of claim 25, wherein the pharmaceutical composition is administered by intramuscular injection.

27. The method of claim 26, wherein the amino acid sequence of the antigenic RSV F protein is at least 98% identical to the amino acid sequence of SEQ ID NO: 4957 and comprises the following amino acid substitutions relative to the amino acid sequence of a native RSV F protein: S155C, S290C, S190F, V207L, A149C and Y458C.

28. The method of claim 27, wherein the amino acid sequence of the antigenic RSV F protein comprises the native RSV F protein transmembrane domain but lacks amino acids 554-574 of the amino acid sequence of the native RSV F protein.

29. The method of claim 27, wherein the pharmaceutical composition is administered in an amount effective to reduce nasal RSV production following RSV infection of the subject.

30. The purified RNA molecule of claim 1, wherein:
the RNA molecule is an mRNA molecule;
the amino acid sequence of the antigenic RSV F protein is at least 98% identical to the amino acid sequence of SEQ ID NO: 4957;
the amino acid sequence of the antigenic RSV F protein comprises the following amino acid substitutions relative to the amino acid sequence of a native RSV F protein: S155C, S290C, S190F, V207L, A149C and Y458C; and
wherein said at least one coding sequence is at least 92% identical to the RNA sequence of SEQ ID NO: 4962.

31. The purified RNA molecule of claim 30, wherein the antigenic RSV F protein comprises the native RSV F protein transmembrane domain.

32. The purified RNA molecule of claim 31, wherein the amino acid sequence of the antigenic RSV F protein lacks amino acids 554-574 of the amino acid sequence of the native RSV F protein.

33. The purified RNA molecule of claim 32, wherein the amino acid sequence of the antigenic RSV F protein comprises a GS linker in place of amino acids 104-144 of the amino acid sequence of the native RSV F protein.

34. The purified RNA molecule of claim 30, wherein the amino acid sequence of the antigenic RSV F protein is at least 99% identical to the amino acid sequence of SEQ ID NO: 4957, and wherein said at least one coding sequence is at least 93% identical to the RNA sequence of SEQ ID NO: 4962.

35. The purified RNA molecule of claim 31, wherein the amino acid sequence of the antigenic RSV F protein is at least 99% identical to the amino acid sequence of SEQ ID NO: 4957, and wherein said at least one coding sequence is at least 93% identical to the RNA sequence of SEQ ID NO: 4962.

36. The purified RNA molecule of claim 32, wherein the amino acid sequence of the antigenic RSV F protein is at least 99% identical to the amino acid sequence of SEQ ID NO: 4957, and wherein said at least one coding sequence is at least 93% identical to the RNA sequence of SEQ ID NO: 4962.

37. The purified RNA molecule of claim 33, wherein the amino acid sequence of the antigenic RSV F protein is at least 99% identical to the amino acid sequence of SEQ ID NO: 4957, and wherein said at least one coding sequence is at least 93% identical to the RNA sequence of SEQ ID NO: 4962.

38. The purified RNA molecule of claim 33, wherein said at least one coding sequence is adapted to human codon usage with most frequently used codons such that the at least one coding sequence has a codon adaptation index (CAI) of at least 0.9.

39. The purified RNA molecule of claim 38, wherein said at least one coding sequence has a CAI of at least 0.95.

40. A pharmaceutical composition comprising purified mRNA molecules of claim 39, wherein said mRNA molecules are formulated with lipid nanoparticles (LNPs), said LNPs comprising a molar ratio of about 20-60% cationic lipid, 5-25% neutral lipid, 25-55% sterol, and 0.5-15% PEG-lipid.

41. The pharmaceutical composition of claim 40, wherein the neutral lipid is distearoylphosphatidylcholine (DSPC), the sterol is cholesterol, and the PEG-lipid is 1-(monomethoxy-polyethyleneglycol)-2,3-dimyristoylglycerol (PEG-DMG).

42. The pharmaceutical composition of claim 41, wherein all uracil nucleotides of the mRNA molecule are replaced by N1-methylpseudouridine (m1) nucleotides and wherein the 5'-cap structure is a cap1 or modified cap1 structure.

43. The purified RNA molecule of claim 30, wherein said at least one coding sequence has a human CAI of at least 0.95.

44. The purified RNA molecule of claim 31, wherein said at least one coding sequence has a human CAI of at least 0.95.

45. The purified RNA molecule of claim 32, wherein said at least one coding sequence has a human CAI of at least 0.95.

* * * * *